US007977052B2

(12) United States Patent
Luke et al.

(10) Patent No.: US 7,977,052 B2
(45) Date of Patent: Jul. 12, 2011

(54) GENETIC POLYMORPHISMS ASSOCIATED WITH CORONARY HEART DISEASE, METHODS OF DETECTION AND USES THEREOF

(75) Inventors: May M. Luke, San Francisco, CA (US); James J. Devlin, Lafayette, CA (US); Dov Shiffman, Palo Alto, CA (US)

(73) Assignee: Celera Corporation, Alameda, CA (US)

( * ) Notice: Subject to any disclaimer, the term of this patent is extended or adjusted under 35 U.S.C. 154(b) by 464 days.

(21) Appl. No.: 11/375,359

(22) Filed: Mar. 13, 2006

(65) Prior Publication Data

US 2006/0223093 A1 Oct. 5, 2006

Related U.S. Application Data

(60) Provisional application No. 60/660,322, filed on Mar. 11, 2005, provisional application No. 60/711,447, filed on Aug. 24, 2005.

(51) Int. Cl.
*C07H 21/04* (2006.01)
*C12Q 1/68* (2006.01)
(52) U.S. Cl. ......... 435/6; 435/91.1; 435/91.2; 536/23.1; 536/24.3
(58) Field of Classification Search ......................... None
See application file for complete search history.

(56) References Cited

U.S. PATENT DOCUMENTS

2003/0092019 A1* 5/2003 Meyer et al. ................ 435/6

FOREIGN PATENT DOCUMENTS

| EP | 1531180 A1 | 5/2005 |
|---|---|---|
| WO | WO 2004/001037 A | 12/2003 |
| WO | WO 2004/081186 A2 | 9/2004 |
| WO | WO 2004/081187 A2 | 9/2004 |

OTHER PUBLICATIONS

Shiffman et al. (Arterioscler Thromb Vasc Biol, vol. 26, pp. 1613-1618. 2006).*
Shiffman et al. (Arterioscler Thromb Vasc. Biol., vol. 28, 173-179, 2008).*
NCBI rs 1010 (see ss1034, Jan. 1999).*
Database SNP NCBI; XP002409007; http://www.ncbi.nlm.nih.gov/SNP/snp ref.cgi?rs=1051038.
Cheng, S. et al., "A Multilocus Genotyping Assay for Candidate Markers of Cardiovascular Disease Risk ", Genome Research, vol. 9, 199, pp. 936-949.
Daley, G. Q., et al., "The Heart SNPs a Beat: Polymorphisms in Candidate Genes for Cardiovascular Disease", Trends .In Cardiovascular Medicine, vol. 11, No. 2, 2001, pp. 60-66.
Podos, S. D. et al., "LDLC Encodes a Brefeldin A-Sensitive, Peripheral Golgi Protein Required for Normal Golgi Function", The Journal of Cell Biology, vol. 127, No. 3, Nov. 1994, pp. 679-691.
Polgar, J. et al., "Vesicle-Associated Membrane Protein 3 (VAMP-3) and VAMP-8 Are Present in Human Platelets and are Required for Granule Secretion", Blood, vol. 100, No. 3, Aug. 2002, pp. 1081-1083.
International Search Report dated Sep. 12, 2007.
Written Opinion dated Sep. 12, 2007.
Database Genebank [Online] XP002546163 retreived from NCBI, Database Accession No. dbSNP ss1540289, Database accession No. AA994106.
Shiffman, D., et al., "Identification of Novel Genetic Markers Associated with Risk of Myocardial Infarction from a Genomic Scale Scan of Putative Functional Polymorphisms", Journal of the American College of Cardiology, Mar. 3, 2004, vol. 43, No. 5, Supplement A, p. 488A.
Shiffman, D., et al., "ROS1 and TAS2R50 are Associated with Myocardial Infarction: Novel Genetic Associations in Three Sample", Circulation, Nov. 10, 2004, vol. 110, No. 17, Supplement S, p. 823.
Yamada, Y., et al., "Prediction of the Risk of Myocardial Infarction from Polymorphisms in Candidate Genes", The New England Journal of Medicine, Dec. 12, 2002, vol. 347, No. 24, pp. 916-923.
Supplementary European Search Report issued for EP009010224, dated Oct. 2, 2009.

* cited by examiner

*Primary Examiner* — Jeanine A Goldberg

(57) ABSTRACT

The present invention is based on the discovery of genetic polymorphisms that are associated with coronary heart disease and in particular stenosis and MI and response to drug treatment. In particular, the present invention relates to nucleic acid molecules containing the polymorphisms, variant proteins encoded by such nucleic acid molecules, reagents for detecting the polymorphic nucleic acid molecules and proteins, and methods of using the nucleic acid and proteins as well as methods of using reagents for their detection.

41 Claims, 1 Drawing Sheet

GENETIC POLYMORPHISMS ASSOCIATED WITH CORONARY HEART DISEASE, METHODS OF DETECTION AND USES THEREOF

CROSS-REFERENCE TO RELATED APPLICATIONS

This application claims the benefit of U.S. provisional application Ser. No. 60/660,322, filed on Mar. 11, 2005, and U.S. provisional application Ser. No. 60/711,447, filed on Aug. 24, 2005, the contents of which are hereby incorporated by reference in its entirety into this application.

FIELD OF THE INVENTION

The present invention is in the field of coronary heart disease (CHD) and in particular stenosis and myocardial infarction (MI) diagnosis and therapy. In particular, the present invention relates to specific single nucleotide polymorphisms (SNPs) in the human genome, and their association with CHD and related pathologies. Based on differences in allele frequencies in the patient population relative to normal individuals, the naturally-occurring SNPs disclosed herein can be used as targets for the design of diagnostic reagents and the development of therapeutic agents, as well as for disease association and linkage analysis. In particular, the SNPs of the present invention are useful for identifying an individual who is at an increased or decreased risk of developing CHD and in particular stenosis and MI, and for early detection of the disease, for providing clinically important information for the prevention and/or treatment of CHD such as stenosis and MI, for screening and selecting therapeutic agents and for predicting a patient's response to therapeutic agents. The SNPs disclosed herein are also useful for human identification applications. Methods, assays, kits, and reagents for detecting the presence of these polymorphisms and their encoded products are provided.

BACKGROUND OF THE INVENTION

CHD is defined in the Framingham study as encompassing angina, MI, coronary insufficiency (which is manifested as ischemia, that is, impaired oxygen flow to the heart muscle), stenosis and coronary heart disease death (Wilson et al., *Circulation* 97:1837-1847 (1998)). It is sometimes recorded through clinical records that indicate the following interventions: coronary artery bypass graft, angioplasty and stent placement in addition to clinical records of MI, angina, or coronary death. This latter definition is used in many population based studies and clinical trials, but it probably misses silent MI events and some unreported angina.

MI (or heart attack) is the most common cause of mortality in developed countries. The incidence of MI is still high despite currently available preventive measures and therapeutic intervention. More than 1,500,000 people in the US suffer acute MI each year (many without seeking help due to unrecognized MI), and one third of these people die. The lifetime risk of coronary artery disease events at age 40 years is 42.4% for men (one in two) and 24.9% for women (one in four) (Lloyd-Jones D M; *Lancet*, 1999 353: 89-92).

MI is a multifactorial disease that involves atherogenesis, thrombus formation and propagation. Thrombosis can result in complete or partial occlusion of coronary arteries. The luminal narrowing or blockage of coronary arteries reduces oxygen and nutrient supply to the cardiac muscle (cardiac ischemia), leading to myocardial necrosis and/or stunning.

MI, unstable angina, and sudden ischemic death are clinical manifestations of cardiac muscle damage. All three endpoints are part of the Acute Coronary Syndrome since the underlying mechanisms of acute complications of atherosclerosis are considered to be the same.

Atherogenesis, the first step of pathogenesis of MI, is a complex interaction between blood elements, mechanical forces, disturbed blood flow, and vessel wall abnormality that results in plaque accumulation. An unstable (vulnerable) plaque was recognized as an underlying cause of arterial thrombotic events and MI. A vulnerable plaque is a plaque, often not stenotic, that has a high likelihood of becoming disrupted or eroded, thus forming a thrombogenic focus. MI due to a vulnerable plaque is a complex phenomenon that includes: plaque vulnerability, blood vulnerability (hypercoagulation, hypothrombolysis), and heart vulnerability (sensitivity of the heart to ischemia or propensity for arrhythmia). Recurrent myocardial infarction (RMI) can generally be viewed as a severe form of MI progression caused by multiple vulnerable plaques that are able to undergo pre-rupture or a pre-erosive state, coupled with extreme blood coagulability.

The current diagnosis of MI is based on the levels of troponin I or T that indicate the cardiac muscle progressive necrosis, impaired electrocardiogram (ECG), and detection of abnormal ventricular wall motion or angiographic data (the presence of acute thrombi). However, due to the asymptomatic nature of 25% of acute MIs (absence of atypical chest pain, low ECG sensitivity), a significant portion of MIs are not diagnosed and therefore not treated appropriately (e.g., prevention of recurrent MIs).

MI risk assessment and prognosis is currently done using classic risk factors or the recently introduced Framingham Risk Index. Both of these assessments put a significant weight on LDL levels to justify preventive treatment. However, it is well established that half of all MIs occur in individuals without overt hyperlipidemia.

Other emerging risk factors of MI are inflammatory biomarkers such as C-reactive protein (CRP), ICAM-1, SAA, TNF α, homocysteine, impaired fasting glucose, new lipid markers (ox LDL, Lp-a, MAD-LDL, etc.) and pro-thrombotic factors (fibrinogen, PAI-1). These markers have significant limitations such as low specificity and low positive predictive value, and the need for multiple reference intervals to be used for different groups of people (e.g., males-females, smokers-non smokers, hormone replacement therapy users, different age groups). These limitations diminish the utility of such markers as independent prognostic markers for MI screening.

Genetics plays an important role in MI risk. Families with a positive family history of MI account for 14% of the general population, 72% of premature MIs, and 48% of all MIs (Williams R R, *Am J Cardiology*, 2001; 87:129). In addition, replicated linkage studies have revealed evidence of multiple regions of the genome that are associated with MI and relevant to MI genetic traits, including regions on chromosomes 14, 2, 3 and 7 (Broeckel U, *Nature Genetics*, 2002; 30: 210; Harrap S, *Arterioscler Thromb Vasc Biol*, 2002; 22: 874-878, Shearman A, *Human Molecular Genetics*, 2000, 9; 9, 1315-1320), implying that genetic risk factors influence the onset, manifestation, and progression of MI. Recent association studies have identified allelic variants that are associated with acute complications of CHD, including allelic variants of the ApoE, ApoA5, Lpa, APOCIII, and Klotho genes.

Genetic markers such as single nucleotide polymorphisms (SNPs) are preferable to other types of biomarkers. Genetic markers that are prognostic for MI can be genotyped early in life and could predict individual response to various risk factors. The combination of serum protein levels and genetic predisposition revealed by genetic analysis of susceptibility genes can provide an integrated assessment of the interaction between genotypes and environmental factors, resulting in synergistically increased prognostic value of diagnostic tests.

Thus, there is an urgent need for novel genetic markers that are predictive of predisposition to CHD such as MI, particularly for individuals who are unrecognized as having a predisposition to MI. Such genetic markers may enable prognosis of MI in much larger populations compared with the populations that can currently be evaluated by using existing risk factors and biomarkers. The availability of a genetic test may allow, for example, appropriate preventive treatments for acute coronary events to be provided for susceptible individuals (such preventive treatments may include, for example, statin treatments and statin dose escalation, as well as changes to modifiable risk factors), lowering of the thresholds for ECG and angiography testing, and allow adequate monitoring of informative biomarkers. Moreover, the discovery of genetic markers associated with MI will provide novel targets for therapeutic intervention or preventive treatments of MI, and enable the development of new therapeutic agents for treating MI and other cardiovascular disorders.

Coronary stenosis is the narrowing of coronary arteries by obstructive atherosclerotic plaques. The coronary arteries supply oxygenated blood flow to the myocardium. Although mild and moderate coronary stenosis do not impede resting coronary flow, stenosis>30-45% starts to restrict maximal coronary flow. Severe coronary stenosis (>70% reduction in luminal diameter) causes stable angina (ischemic chest pain upon exertion). Significant stenosis contributes, along with plaque rupture and thrombus formation, coronary spasm, or inflammation/infection, to unstable angina as well as myocardial infarction. Together with arrhythmia, coronary stenosis is a major factor of sudden cardiac deaths, as evidenced by its presence in two or more major coronary arteries in 90% of adult sudden cardiac death victims.

Coronary stenosis is a prevalent disease. Each year in the United States, 440,000 new cases of stable angina and 150,000 new cases of unstable angina occur. This year, an estimated 1.1 million Americans will have a new or recurrent heart attack. These incidences result in over six million individuals in the U.S. living with stable or unstable angina pectoris, a debilitating condition, and over seven million individuals in the U.S. living with a history of myocardial infarction. Coronary stenosis is frequently a deadly disease. It is a major underlying cause of CHD, which is the single largest cause of death in the U.S. Over half a million coronary deaths, including 250,000 sudden cardiac deaths, occur each year in U.S.

There is, therefore, an unmet need in early diagnosis and prognosis of asymptomatic coronary stenosis. This need is particularly significant given that early diagnosis or prognosis results can significantly influence the course of disease by influencing treatment choices (for example, those with genetic risks can be treated to modify risk factors such as hypertension, diabetes, inactivity, dyslipidemia, etc.), thresholds (e.g., lipid levels used to trigger the use of lipid-lowering drugs), and goals (e.g., target blood pressure or lipid levels), and possibly enhance compliance.

Diagnosis of coronary stenosis currently starts by assessing if the risk profiles (e.g., hypertension, dyslipidemia, family history, diabetes, etc.) and symptoms (e.g., angina) of patients are consistent with coronary heart disease, followed most commonly by resting and exercise EKGs. However, risk assessments and EKGs are imperfect diagnostic tests for stenosis since they can be both insensitive (giving false negatives) and non-specific (giving false positives). Coronary arteriography is the definitive test for assessing the severity of coronary stenosis, however, it is not very sensitive in early detection of mild stenosis. It is also an invasive procedure with a small risk of death due to the catheterization procedure and the contrast dye. Because of this risk, it is typically only used at a time when coronary stenosis is considered likely from symptoms or other tests, which is hardly an ideal time to start intervention.

Coronary stenosis risk is presumed to have a strong genetic component. It is well known that several major risk factors of coronary disease are heritable, e.g. serum lipid levels (Perusse L. et. al., *Arterioscler Thromb Vasc Biol* (1997): 17(11) 3263-9) and obesity (Rice T. et. al., *Int J Obes Relat Metab Disord* (1997):21(11) 1024-31). Indeed, several known genetic defects are individually sufficient to cause elevated serum LDL-cholesterol (e.g., familial hypercholesterolemia) leading to premature coronary disease (Goldstein and Brown, *Science* 292 (2001): 1310-12). In addition, linkage studies in humans have replicated the findings of the link of several chromosomal regions (quantitative trait loci) to coronary heart disease and related diseases and risk factors (Pajukanta P. et. al., *Am J Hum Genet* 67 (2000):1481-93, Francke S. et. al., *Human Molecular Genetics* (2001): 10 (24) 2751-65). Finally, a family history of premature coronary disease is a significant factor in the risk assessment and diagnosis of coronary disease (Braunwald E., Zipes D. and Libby P., *Heart Disease*, 6$^{th}$ ed. W. B. Saunders Company, 2001, 28).

Although many risk factors for coronary stenosis have been identified, including age, diabetes, hypertension, high serum cholesterol, smoking, etc., and genetic factors play significant roles in several of these risk factors, significant genetic risk factors are likely to exist which have not been identified to date. In addition to the anecdotal coronary disease patients that exhibit few traditional risk factors, a study of multiple existing risk factors showed that only half of the "population-attributable risk" was attributable to known risk factors (Change M. et. al., *J Clin Epidemiol* (2001) 54 (6) 634-44). Therefore, the presently known risk factors are inadequate for predicting coronary stenosis risk in individuals. Given the magnitude of the disease, there is an urgent need for genetic markers that are predictive of coronary stenosis risk. Such genetic markers could increase the prognostic ability of existing risk assessment methods and complement current diagnostic methods such as exercise EKG, especially in early detection of disease when intervention is most effective and should ideally start.

Reduction of coronary and cerebrovascular events and total mortality by treatment with HMG-CoA reductase inhibitors (statins) has been demonstrated in a number of randomized, double blinded, placebo controlled prospective trials (Waters, D. D., *Clin Cardiol*, 2001. 24(8 Suppl): p. III3-7, Singh, B. K. and J. L. Mehta, *Curr. Opin. Cardiol.*, 2002. 17(5): p. 503-11). These drugs have their primary effect through the inhibition of hepatic cholesterol synthesis, thereby upregulating LDL receptor in the liver. The resultant increase in LDL catabolism results in decreased circulating LDL, a major risk factor for cardiovascular disease.

Statins can be divided into two types according to their physicochemical and pharmacokinetic properties. Statins such as lovastatin, simvastatin, atorvastatin, and cerevastatin are hydrophobic in nature and, as such, diffuse across membranes and thus are highly cell permeable. Hydrophilic statins such as pravastatin are more polar, such that they require specific cell surface transporters for cellular uptake (Ziegler, K. and W. Stunkel, *Biochim Biophys Acta*, 1992. 1139(3): p. 203-9, Yamazaki, M., et al., *Am J Physiol*, 1993. 264(1 Pt 1): p. G36-44, Komai, T., et al., *Biochem Pharmacol*, 1992.

43(4): p. 667-70). The latter statin utilizes a transporter, OATP2, whose tissue distribution is confined to the liver and, therefore, they are relatively hepato-specific inhibitors (Hsiang, B., et al., *J Biol Chem*, 1999. 274(52): p. 37161-8). The former statins, not requiring specific transport mechanisms, are available to all cells and they can directly impact a much broader spectrum of cells and tissues. These differences in properties may influence the spectrum of activities that each statin possesses. Pravastatin, for instance, has a low myopathic potential in animal models and myocyte cultures compared to other hydrophobic statins (Masters, B. A., et al., *Toxicol Appl Pharmacol*, 1995. 131 (1): p. 163-74. Nakahara, K., et al., *Toxicol Appl Pharmacol*, 1998. 152(1): p. 99-106, Reijneveld, J. C., et al., *Pediatr Res*, 1996. 39(6): p. 1028-35).

Evidence from gene association studies is accumulating to indicate that responses to drugs are, indeed, at least partly under genetic control. As such, pharmacogenetics—the study of variability in drug responses attributed to hereditary factors in different populations—may significantly assist in providing answers toward meeting this challenge (Roses, A. D., *Nature*, 2000. 405(6788): p. 857-65, Mooser, V., et al., *J Thromb Haemost*, 2003. 1(7): p. 1398-1402, Humma, L. M. and S. G. Terra, *Am. J. Health Syst Pharm*, 2002. 59(13): p. 1241-52). Numerous associations have been reported between selected genotypes, as defined by SNPs and other sequence variations and specific responses to cardiovascular drugs. Polymorphisms in several genes have been suggested to influence responses to statins including CETP (Kuivenhoven, J. A., et al., *N Engl J Med*, 1998. 338(2): p. 86-93), beta-fibrinogen (de Maat, M. P., et al., *Arterioscler Thromb Vasc Biol*, 1998. 18(2): p. 265-71), hepatic lipase (Zambon, A., et al., *Circulation*, 2001. 103(6): p. 792-8, lipoprotein lipase (Jukema, J. W., et al., *Circulation*, 1996. 94(8): p. 1913-8), glycoprotein IIIa (Bray, P. F., et al., *Am J Cardiol*, 2001. 88(4): p. 347-52), stromelysin-1 (de Maat, M. P., et al., *Am J Cardiol*, 1999. 83(6): p. 852-6), and apolipoprotein E (Gerdes, L. U., et al., *Circulation*, 2000. 101(12): p. 1366-71, Pedro-Botet, J., et al., *Atherosclerosis*, 2001. 158(1): p. 183-93). Some of these variants were shown to effect clinical events while others were associated with changes in surrogate endpoints. Thus there is the need for markers and individuals responsiveness to statins.

SNPs

The genomes of all organisms undergo spontaneous mutation in the course of their continuing evolution, generating variant forms of progenitor genetic sequences (Gusella, *Ann. Rev. Biochem.* 55, 831-854 (1986)). A variant form may confer an evolutionary advantage or disadvantage relative to a progenitor form or may be neutral. In some instances, a variant form confers an evolutionary advantage to the species and is eventually incorporated into the DNA of many or most members of the species and effectively becomes the progenitor form. Additionally, the effects of a variant form may be both beneficial and detrimental, depending on the circumstances. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence gives rise to genetic polymorphisms, including SNPs.

Approximately 90% of all genetic polymorphisms in the human genome are SNPs. SNPs are single base positions in DNA at which different alleles, or alternative nucleotides, exist in a population. The SNP position (interchangeably referred to herein as SNP, SNP site, SNP locus, SNP marker or marker) is usually preceded by and followed by highly conserved sequences of the allele (e.g., sequences that vary in less than 1/100 or 1/1000 members of the populations). An individual may be homozygous or heterozygous for an allele at each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel" (Weber et al., "Human diallelic insertion/deletion polymorphisms," *Am J Hum Genet* 2002 October; 71(4):854-62).

A synonymous codon change, or silent mutation/SNP (terms such as "SNP," "polymorphism," "mutation," "mutant," "variation," and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous. codon change that causes the destruction of a stop codon, thereby resulting in an extended polypeptide product. While SNPs can be bi-, tri-, or tetra-allelic, the vast majority of the SNPs are bi-allelic, and are thus often referred to as "bi-allelic markers," or "di-allelic markers."

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases (Stephens et al. *Science* 293, 489-493, 20 Jul. 2001).

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence. In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as stenosis or MI, and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific pathological condition, such as pathologies related to CHD and in particular, stenosis and MI. Once a statistically significant association is established between one or more SNP(s) and a pathological condition (or other phenotype) of interest, then the region around the SNP can optionally be thoroughly screened to identify the causative genetic locus/sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process. (Linder et al. (1997), *Clinical Chemistry*, 43, 254; Marshall (1997), *Nature Biotechnology*, 15, 1249; International Patent Application WO 97/40462, Spectra Biomedical; and Schafer et al. (1998), *Nature Biotechnology*, 16: 3).

SUMMARY OF THE INVENTION

The present invention relates to the identification of novel SNPs, unique combinations of such SNPs, and haplotypes of SNPs that are associated with CHD, and in particular stenosis and MI. The polymorphisms disclosed herein are directly useful as targets for the design of diagnostic reagents and the development of therapeutic agents for use in the diagnosis and treatment of CHD, and in particular stenosis and MI, as well as predicting a patient's response to therpeutic agents such as statins.

Based on the identification of SNPs associated with CHD, the present invention also provides methods of detecting these variants as well as the design and preparation of detection reagents needed to accomplish this task. The invention specifically provides, for example, novel SNPs in genetic sequences involved in stenosis and MI, isolated nucleic acid molecules (including, for example, DNA and RNA molecules) containing these SNPs, variant proteins encoded by nucleic acid molecules containing such SNPs, antibodies to the encoded variant proteins, computer-based and data storage systems containing the novel SNP information, methods of detecting these SNPs in a test sample, methods of identifying individuals who have an altered (i.e., increased or decreased) risk of developing CHD based on the presence or absence of one or more particular nucleotides (alleles) at one or more SNP sites disclosed herein or the detection of one or more encoded variant products (e.g., variant mRNA transcripts or variant proteins), methods of identifying individuals who are more or less likely to respond to a treatment (or more or less likely to experience undesirable side effects from a treatment, etc.), methods of screening for compounds useful in the treatment of a disorder associated with a variant gene/protein, compounds identified by these methods, methods of treating disorders mediated by a variant gene/protein, methods of using the novel SNPs of the present invention for human identification, etc.

In Tables 1-2, the present invention provides gene information, references to the identification of transcript sequences (SEQ ID NOS: 1-67), encoded amino acid sequences (SEQ ID NOS: 68-134), genomic sequences (SEQ ID NOS: 229-299), transcript-based context sequences (SEQ ID NOS: 135-228) and genomic-based context sequences (SEQ ID NOS: 300-504) that contain the SNPs of the present invention, and extensive SNP information that includes observed alleles, allele frequencies, populations/ethnic groups in which alleles have been observed, information about the type of SNP and corresponding functional effect, and, for cSNPs, information about the encoded polypeptide product. The actual transcript sequences (SEQ ID NOS: 1-67), amino acid sequences (SEQ ID NOS: 68-134), genomic sequences (SEQ ID NOS: 229-299), transcript-based SNP context sequences (SEQ ID NOS: 135-228), and genomic-based SNP context sequences (SEQ ID NOS: 300-504), together with primer sequences (SEQ ID NOS: 505-783) are provided in the Sequence Listing.

In one embodiment of the invention, applicants teach a method for identifying an individual who has an altered risk for developing CHD, comprising detecting a single nucleotide polymorphism (SNP) in any one of the nucleotide sequences of SEQ ID NOS: 1-67 and 135-504 in said individual's nucleic acids, wherein the SNP is as specified in Table 1 and Table 2, respectively, and the presence of the SNP is correlated with an altered risk for MI in said individual. In a specific embodiment of the present invention, SNPs that occur naturally in the human genome are provided as isolated nucleic acid molecules. These SNPs are associated with CHD, and in particular stenosis and MI such that they can have a variety of uses in the diagnosis and/or treatment of CHD and related pathologies. In an alternative embodiment, a nucleic acid of the invention is an amplified polynucleotide, which is produced by amplification of a SNP-containing nucleic acid template. In another embodiment, the invention provides for a variant protein that is encoded by a nucleic acid molecule containing a SNP disclosed herein.

In yet another embodiment of the invention, a reagent for detecting a SNP in the context of its naturally-occurring flanking nucleotide sequences (which can be, e.g., either DNA or mRNA) is provided. In particular, such a reagent may be in the form of, for example, a hybridization probe or an amplification primer that is useful in the specific detection of a SNP of interest. In an alternative embodiment, a protein detection reagent is used to detect a variant protein that is encoded by a nucleic acid molecule containing a SNP disclosed herein. A preferred embodiment of a protein detection reagent is an antibody or an antigen-reactive antibody fragment.

Various embodiments of the invention also provide kits comprising SNP detection reagents, and methods for detecting the SNPs disclosed herein by employing detection reagents. In a specific embodiment, the present invention provides for a method of identifying an individual having an increased or decreased risk of developing MI by detecting the presence or absence of one or more SNP alleles disclosed herein. In another embodiment, a method for diagnosis of stenosis or MI by detecting the presence or absence of one or more SNP alleles disclosed herein is provided.

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment of CHD, and in particular stenosis and MI.

An aspect of this invention is a method for treating CHD, and in particular stenosis and MI, in a human subject wherein said human subject harbors a SNP, gene, transcript, and/or encoded protein identified in Tables 1-2, which method comprises administering to said human subject a therapeutically or prophylactically effective amount of one or more agents counteracting the effects of the disease, such as by inhibiting (or stimulating) the activity of the gene, transcript, and/or encoded protein identified in Tables 1-2.

Another aspect of this invention is a method for identifying an agent useful in therapeutically or prophylactically treating CHD, and in particular stenosis and MI, in a human subject wherein said human subject harbors a SNP, gene, transcript, and/or encoded protein identified in Tables 1-2, which method comprises contacting the gene, transcript, or encoded protein with a candidate agent under conditions suitable to allow formation of a binding complex between the gene, transcript, or encoded protein and the candidate agent and detecting the formation of the binding complex, wherein the presence of the complex identifies said agent.

Another aspect of this invention is a method for treating CHD such as stenosis and/or MI in a human subject, which method comprises:

(i) determining that said human subject harbors a SNP, gene, transcript, and/or encoded protein identified in Tables 1-2, and (ii) administering to said subject a therapeutically or prophylactically effective amount of one or more agents counteracting the effects of the disease such as stating.

Many other uses and advantages of the present invention will be apparent to those skilled in the art upon review of the detailed description of the preferred embodiments herein. Solely for clarity of discussion, the invention is described in the sections below by way of non-limiting examples.

Description of the Files Contained on the CD-R Named CDR Duplicate Copy 1 and CDR Duplicate Copy 2

Each of the the CD-Rs contains the following three files:

1) File SEQLIST_000001ORD.txt provides the Sequence Listing. The Sequence Listing provides the transcript sequences (SEQ ID NOS: 1-67) and protein sequences (SEQ ID NOS: 68-134) as referred to in Table 1, and genomic sequences (SEQ ID NOS: 229-299) as referred to in Table 2, for each CHD-associated gene or genomic region (for intergenic SNPs) that contains one or more SNPs of the present invention. Also provided in the Sequence Listing are context sequences flanking each SNP, including both transcript-based context sequences as referred to in Table 1 (SEQ ID NOS: 135-228) and genomic-based context sequences as referred to in Table 2 (SEQ ID NOS: 300-504). In addition, the Sequence Listing provides the primer sequences from Table 3 (SEQ ID NOS: 505-783), which are oligonucleotides that have been synthesized and used in the laboratory to assay the SNPs disclosed in Tables 4-8 during the course of association studies to verify the association of these SNPs with coronary heart disease (CHD). The context sequences generally provide 100 bp upstream (5') and 100 bp downstream (3') of each SNP, with the SNP in the middle of the context sequence, for a total of 200 bp of context sequence surrounding each SNP. File SEQLIST_1572ORD.txt is 1,562 KB in size, and was created on Mar. 13, 2006. A computer readable format of the sequence listing is also submitted herein on a separate CDR labeled CRF. The information recorded in the CRF CDR is identical to the sequence listing as provided on the CDR Duplicate Copy 1 and Copy 2.

2) File TABLE 1_000001ORD.txt provides Table 1. File TABLE 1_000001ORD.txt is 106 KB in size, and was created on Mar. 13, 2006.

3) File TABLE2_000001ORD.txt provides Table 2. File TABLE2_000001ORD.txt is 155 KB in size, and was created on Mar. 13, 2006.

The material contained on the CD-R labeled CD000001ORD is hereby incorporated by 20 reference pursuant to 37 CFR 1.77(b) (4).

Description of Table 1 and Table 2

Table 1 and Table 2 (both provided on the CD-R) disclose the SNP and associated gene/transcript/protein information of the present invention. For each gene, Table 1 provides a header containing gene, transcript and protein information, followed by a transcript and protein sequence identifier (SEQ ID), and then SNP information regarding each SNP found in that gene/transcript including the transcript context sequence. For each gene in Table 2, a header is provided that contains gene and genomic information, followed by a genomic sequence identifier (SEQ ID) and then SNP information regarding each SNP found in that gene, including the genomic context sequence.

Note that SNP markers may be included in both Table 1 and Table 2; Table 1 presents the SNPs relative to their transcript sequences and encoded protein sequences, whereas Table 2 presents the SNPs relative to their genomic sequences. In some instances Table 2 may also include, after the last gene sequence, genomic sequences of one or more intergenic regions, as well as SNP context sequences and other SNP information for any SNPs that lie within these intergenic regions. Additionally, in either Table 1 or 2 a "Related Interrogated SNP" may be listed following a SNP which is determined to be in LD with that interrogated SNP according to the given Power value. SNPs can readily be cross-referenced between all Tables based on their Celera hCV (or, in some instances, hDV) identification numbers, and to the Sequence Listing based on their corresponding SEQ ID NOS.

The gene/transcript/protein information includes:
a gene number (1 through n, where n=the total number of genes in the Table)
a Celera hCG and UID internal identification numbers for the gene
a Celera hCT and UID internal identification numbers for the transcript (Table 1 only)
a public Genbank accession number (e.g., RefSeq NM number) for the transcript (Table 1 only)
a Celera hCP and UID internal identification numbers for the protein encoded by the hCT transcript (Table 1 only)

a public Genbank accession number (e.g., RefSeq NP number) for the protein (Table 1 only)
an art-known gene symbol
an art-known gene/protein name
Celera genomic axis position (indicating start nucleotide position-stop nucleotide position)
the chromosome number of the chromosome on which the gene is located
an OMIM (Online Mendelian Inheritance in Man; Johns Hopkins University/NCBI) public reference number for obtaining further information regarding the medical significance of each gene
alternative gene/protein name(s) and/or symbol(s) in the OMIM entry Note that, due to the presence of alternative splice forms, multiple transcript/protein entries may be provided for a single gene entry in Table 1; i.e., for a single Gene Number, multiple entries may be provided in series that differ in their transcript/protein information and sequences.

Following the gene/transcript/protein information is a transcript context sequence and (Table 1), or a genomic context sequence (Table 2), for each SNP within that gene.

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (such SNPs are identified as "INTERGENIC" for SNP type).

Note that the transcript, protein, and transcript-based SNP context sequences are all provided in the Sequence Listing. The transcript-based SNP context sequences are provided in both Table 1 and also in the Sequence Listing. The genomic and genomic-based SNP context sequences are provided in the Sequence Listing. The genomic-based SNP context sequences are provided in both Table 2 and in the Sequence Listing. SEQ ID NOS are indicated in Table 1 for the transcript-based context sequences (SEQ ID NOS: 135-228); SEQ ID NOS are indicated in Table 2 for the genomic-based context sequences (SEQ ID NOS: 300-504).

The SNP information includes:
context sequence (taken from the transcript sequence in Table 1, the genomic sequence in Table 2) with the SNP represented by its IUB code, including 100 bp upstream (5') of the SNP position plus 100 bp downstream (3') of the SNP position (the transcript-based SNP context sequences in Table 1 are provided in the Sequence Listing as SEQ ID NOS: 135-228; the genomic-based SNP context sequences in Table 2 are provided in the Sequence Listing as SEQ ID NOS: 300-504).
Celera hCV internal identification number for the SNP (in some instances, an "hDV" number is given instead of an "hCV" number).
The corresponding public identification number for the SNP, the RS number.
SNP position (position of the SNP within the given transcript sequence (Table 1) or within the given genomic sequence (Table 2)).
"Related Interrogated SNP" is as the interrogated SNP with which the listed SNP is in LD at the given value of Power.
SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP observed during re-sequencing of nucleic acid samples from individuals who have a disease, "dbSNP"=SNP observed in the dbSNP public database, "HGBASE"=SNP observed in the HGBASE public database, "HGMD"=SNP observed in the Human Gene Mutation Database (HGMD) public database, "HapMap"=SNP observed in the International HapMap Project public database, "CSNP"=SNP observed in an internal Applied Biosystems (Foster City, Calif.) database of coding SNPS (cSNPs)). Note that multiple "Applera" source entries for a single SNP indicate that the same SNP was covered by multiple overlapping amplification products and the re-sequencing results (e.g., observed allele counts) from each of these amplification products is being provided.
Population/allele/allele count information in the format of [population1(first_allele,count|second_allele,count) population2(first_allele,count|second_allele,count) total (first_allele,total count|second_allele,total count)]. The information in this field includes populations/ethnic groups in which particular SNP alleles have been observed ("cau"=Caucasian, "his"=Hispanic, "chn"=Chinese, and "afr"=African-American, "jpn"=Japanese, "ind"=Indian, "mex"=Mexican, "ain"="American Indian, "cra"=Celera donor, "no_pop"=no population information available), identified SNP alleles, and observed allele counts (within each population group and total allele counts), where available ["–" in the allele field represents a deletion allele of an insertion/deletion ("indel") polymorphism (in which case the corresponding insertion allele, which may be comprised of one or more nucleotides, is indicated in the allele field on the opposite side of the "|"); "–" in the count field indicates that allele count information is not available]. For certain SNPs from the public dbSNP database, population/ethnic information is indicated as follows (this population information is publicly available in dbSNP): "HISP1"=human individual DNA (anonymized samples) from 23 individuals of self-described HISPANIC heritage; "PAC1"=human individual DNA (anonymized samples) from 24 individuals of self-described PACIFIC RIM heritage; "CAUC1"=human individual DNA (anonymized samples) from 31 individuals of self-described CAUCASIAN heritage; "AFR1"=human individual DNA (anonymized samples) from 24 individuals of self-described AFRICAN/AFRICAN AMERICAN heritage; "P1"=human individual DNA (anonymized samples) from 102 individuals of self-described heritage; "PA130299515"; "SC_12_A"=SANGER 12 DNAs of Asian origin from Corielle cell repositories, 6 of which are male and 6 female; "SC_12_C"=SANGER 12 DNAs of Caucasian origin from Corielle cell repositories from the CEPH/UTAH library. Six male and 6 female; "SC_12_AA"=SANGER 12 DNAs of African-American origin from Corielle cell repositories 6 of which are male and 6 female; "SC_95_C"=SANGER 95 DNAs of Caucasian origin from Corielle cell repositories from the CEPH/UTAH library; and "SC_12_CA"=Caucasians—12 DNAs from Corielle cell repositories that are from the CEPH/UTAH library. Six male and 6 female.

Note that for SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

Note that semicolons separate population/allele/count information corresponding to each indicated SNP source; i.e., if four SNP sources are indicated, such as "Celera," "dbSNP," "HGBASE," and "HGMD," then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information.

SNP type (e.g., location within gene/transcript and/or predicted functional effect) ["MIS-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary].

Protein coding information (Table 1 only), where relevant, in the format of [protein SEQ ID NO:#, amino acid position, (amino acid-1, codon1) (amino acid-2, codon2)]. The information in this field includes SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPs, one amino acid and at least two different codons are generally indicated, etc.). In instances where the SNP is located outside of a protein-coding region (e.g., in a UTR region), "None" is indicated following the protein SEQ ID NO.

Description of Table 3

Table 3 provides sequences (SEQ ID NOS: 505-783) of oligonucleotides that have been synthesized and used in the laboratory to assay the SNPs disclosed in Tables 4-8 during the course of association studies to verify the association of these SNPs with coronary heart disease (CHD). The experiments that were conducted using these primers are explained in detail in Examples 1 and 2, below.

Table 3 provides the following:

the column labeled "hCV" lists the Celera identifier hCV number for each SNP marker.

the column labeled "Alleles" designates the two alternative alleles at the SNP site identified by the hCV identification number that are targeted by the allele-specific oligonucleotides.

allele-specific oligonucleotides with their respective SEQ ID numbers are shown in the next two columns, "Sequence A (allele-specific primer)" and "Sequence B (allele-specific primer)." These two primers were used in conjunction with a common primer in each PCR assay to genotype DNA samples for each SNP marker. Note that alleles may be presented in Table 3 based on a different orientation (i.e., the reverse complement) relative to how the same alleles are presented in Tables 1 and 2.

common oligonucleotides with their respective SEQ ID numbers are shown in the column, "Sequence C (common primer)." Each common primer was used in conjunction with the two allele-specific primers to genotype DNA samples for each SNP marker.

All sequences are given in the 5' to 3' direction.

Description of Table 4

Table 4 provides results of statistical analyses for certain SNPs disclosed in Tables 1 and 2 (SNPs can be cross-referenced between tables based on their hCV identification numbers), and the association of these SNPs with CHD. The experiment that provided this data is explained in detail in Example 1, below.

The statistical results provided in Table 4 show that the association of these SNPs with MI is supported by P values<0.1 in an allelic or genotypic association test, the latter based on dominant or recessive modes of inheritance.

In Table 4, the column labeled "SNP Marker Identifier" presents each SNP as identified by its unique Celera hCV identification number. The column "Gene Symbol" presents the standard symbol for the gene containing the SNP; i.e., the symbol approved by the Human Genome Organization (HUGO) Gene Nomenclature Committee. In the case where a gene symbol is not known or the SNP is found in an intergenic region, the word "none" is present. The column labeled "Risk Allele" presents a variant nucleotide for each of the identified SNPs. The allele may be presented in Table 4 as the reverse complement relative to how the same allele is presented in Tables 1 and/or 2. "CCF" samples were obtained from patients at the Cleveland Clinic Foundation Heart Center. "UCSF" samples were from the University of California at San Francisco. The columns labeled "Design" present the coronary endpoints that a particular SNP is associated with, in the respective CCF or UCSF study. Reference is made to the Design Key below the table for explanation. For example, in Design A, SNP association with MI was found when cases with MI were compared to controls who did not have MI or any other cardiovascular disease (CVD). In Design B, younger MI cases were compared to older controls that did not have any CVD. The numbers of cases and controls genotyped for each assay are provided. The column labeled "Stratum" lists the subgroups of individuals from cases and controls in which MI association was observed. Reference is made to the Stratum Key below the table for an explanation of symbols used. "All" indicates that the association was observed in all individuals tested, "M" or "FM" indicates the association was observed in males or females, "S+" or "S-" indicates an association with MI was observed in smokers or non-smokers, respectively. "BP+" indicates the effect was observed in patients with hypertension, etc. The column labeled "Mode" indicates the genetic model under which the P value for association was calculated. Under a genotypic analysis (described in examples below), when two copies of the SNP are required to see the observed effect, the mode is recessive, or "Rec." When one or two copies of the SNP are required to see the association, the mode is dominant, or "Dom." When the association is found by simply comparing the frequency of the allele in the case population to the control population, the mode is "Allelic." The allelic mode closely approximates an additive model. The column labeled "P val" indicates the results of either the asymptotic chi-square test for genotypic association (Rec or Dom), or the Fisher Exact test (Allelic) to determine if the qualitative phenotype is a function of the SNP genotype. The column labeled "OR" (odds ratio) indicates an approximation of the relative risk for an individual for the defined endpoint associated with the SNP. An OR of less than one indicates that the allele is protective for MI, and an OR greater than one indicates the allele increases the risk of MI.

Note that SNPs can be cross-referenced between the tables herein based on their hCV identification numbers. However, four of the SNPs that are included in the tables may possess two different hCV identification numbers, as follows:

hCV15965459 and hCV22274416 are directed to identical SNP markers.
hCV1801149 and hCV25473208 are directed to identical SNP markers.
hCV3185278 and hCV28026155 are directed to identical SNP markers.
hCV9626088 and hCV26809148 are directed to identical SNP markers.

Description of Table 5

Table 5 provides the results of statistical analyses for certain SNPs disclosed in Tables 1 and 2; namely, the association of SNP alleles with a risk for MI based on case-control studies. The experiment that provided this data is explained in detail in Example 1, below. Note that SNPs can be cross-referenced between tables based on their hCV identification numbers. The statistical results provided in Table 5 show that the association of these SNPs with MI is supported by P values<0.05 in allelic association tests. The data presented were obtained from individually genotyped samples from UCSF. Case samples were limited to patients that had a history of MI, while controls had no history of MI.

In Table 5, the column labeled "Gene Symbol" presents the standard symbol for the gene containing the SNP; i.e., the symbol approved by the Human Genome Organization (HUGO) Gene Nomenclature Committee. The column labeled "SNP Marker Identifier" presents each SNP as identified by its unique Celera identifier, the hCV number. The column labeled "Risk Allele" presents the SNP allele for which the odds ratio was >1.0 for cases vs. controls. Each allele may be presented in Tables 1 and/or 2 as the complement of the allele presented in Table 5; e.g., "G" may be presented as its complement, "C." The column labeled "P value" indicates the results of the Fisher Exact test, to determine the association of one allele with risk for MI. The column labeled "OR" (odds ratio) shows an approximation of the relative MI risk for individuals with the risk allele, based on the observed frequencies of alleles in cases vs. controls. An OR less than one would indicate an allele is protective for MI, and an OR greater than one indicates the allele is associated with an increased risk of MI. Also shown is the 90% confidence interval calculated around each OR presented ("OR 90% CI").

Description of Table 6

Table 6 provides the results of statistical analyses for certain SNPs disclosed in Tables 1 and 2; namely, the association of SNP genotypes with a risk for MI based on case-control studies. The experiment that provided this data is explained in detail in Example 1, below. The statistical results provided in Table 6 show that the association of these SNPs with MI is supported by P values<0.05 in genotypic association tests, when cases are heterozygous or homozygous for the risk allele, depending on the SNP. The data presented were obtained from individually genotyped samples from UCSF. Case samples were limited to patients that had a history of MI, while controls had no history of MI. The numbers of cases and controls of each genotype are provided in this table. P values for genotypic association with MI were determined using the asymptotic chi-square test.

Description of Table 7

Table 7 provides the results of statistical analyses for certain SNPs disclosed in Tables 1 and 2; namely, the association of SNP genotypes with a risk for MI based on case-control studies. The SNPs of table 7 were selected from genes in which other SNPs were found to be accociated with MI (Example 1 below, and Tables 5-6).

The statistical results provided in Table 7 show that the association of these SNPs with MI is supported by P values<0.10 in allelic or genotypic association tests, depending on the SNP. The data presented were obtained from individually genotyped samples from UCSF. Case samples were limited to patients that had a history of MI, while controls had no history of MI. The column "Gene Symbol" indicates the gene region from which the investigated markers were obtained. P values for genotypic association with MI (Dom or Rec) were determined using the asymptotic chi-square test; allelic association P value were obtained using the Fisher Exact test.

Description of Table 8

Table 8 provides the results of a statistical analysis of SNP hCV3130332, disclosed in Tables 1 and 2; namely, the association this SNP with a risk for stenosis based on case-control studies. The experiment that provided this data is explained in detail in Example 2, below.

The statistical results provided in Table 8 show that the association of this SNP with stenosis is supported by P values<0.05 in allelic and genotypic (Dom/Rec) association tests. The data presented were obtained from individually genotyped samples from CCF and UCSF. Case samples were limited to patients with the most severe stenosis, while controls had the least severe stenosis and no MI history, as described in Example 2, below.

In Table 8, the column labeled "Gene Symbol" presents the standard symbol for the gene containing the SNP. The column labeled "SNP Marker Identifier" presents the marker as identified by its unique Celera identifier, the hCV number. The column labeled "Risk Allele" presents the SNP allele for which the odds ratio was >1.0 for cases vs. controls. The columns labeled "P value" indicate the results (in CCF and UCSF samples) of the Fisher Exact test to determine association of one allele with risk for MI, or the results of the asymptotic chi-square test, in the case of genotypic (dominant/recessive) association with stenosis. The columns labeled "OR" (odds ratio) show an approximation of the relative stenosis risk for individuals with the risk allele, based on the observed frequencies of the risk allele in cases vs. controls. An OR less than one would indicate an allele is protective for stenosis, and an OR greater than one indicates the allele is associated with an increased risk of stenosis. Also shown are the 95% confidence intervals for the two sample sets, calculated around each OR presented ("OR 95% CI").

Description of Table 9

Table 9 provides a list of the sample LD SNPs that are related to and derived from an interrogated SNP. These LD SNPs are provided as an example of the groups of SNPs which can also serve as markers for disease association based on their being in LD with the interrogated SNP. The criteria and process of selecting such LD SNPs, including the calculation of the $r^2$ value and the $r^2$ threshold value, are described in Example 3, below.

In Table 9, the column labeled "Interrogated SNP" presents each marker as identified by its unique identifier, the hCV number. The column labeled "Interrogated rs" presents the publicly known identifier rs number for the corresponding hCV number. The column labeled "LD SNP" presents the hCV numbers of the LD SNPs that are derived from their corresponding interrogated SNPs. The column labeled "LD SNP rs" presents the publicly known rs number for the corresponding hCV number. The column labeled "Power" presents the level of power where the $r^2$ threshold is set. For example, when power is set at 70%, the threshold $r^2$ value calculated therefrom is the minimum $r^2$ that an LD SNP must have in reference to an interrogated SNP, in order for the LD SNP to be classified as a marker capable of being associated with a disease phenotype at greater than 70% probability. The column labeled "Threshold $r^2$" presents the minimum value of $r^2$ that an LD SNP must meet in reference to an interrogated SNP in order to qualify as an LD SNP. The column labeled "$r^2$" presents the actual $r^2$ value of the LD SNP in reference to the interrogated SNP to which it is related.

DETAILED DESCRIPTION OF THE INVENTION

Figure 1:
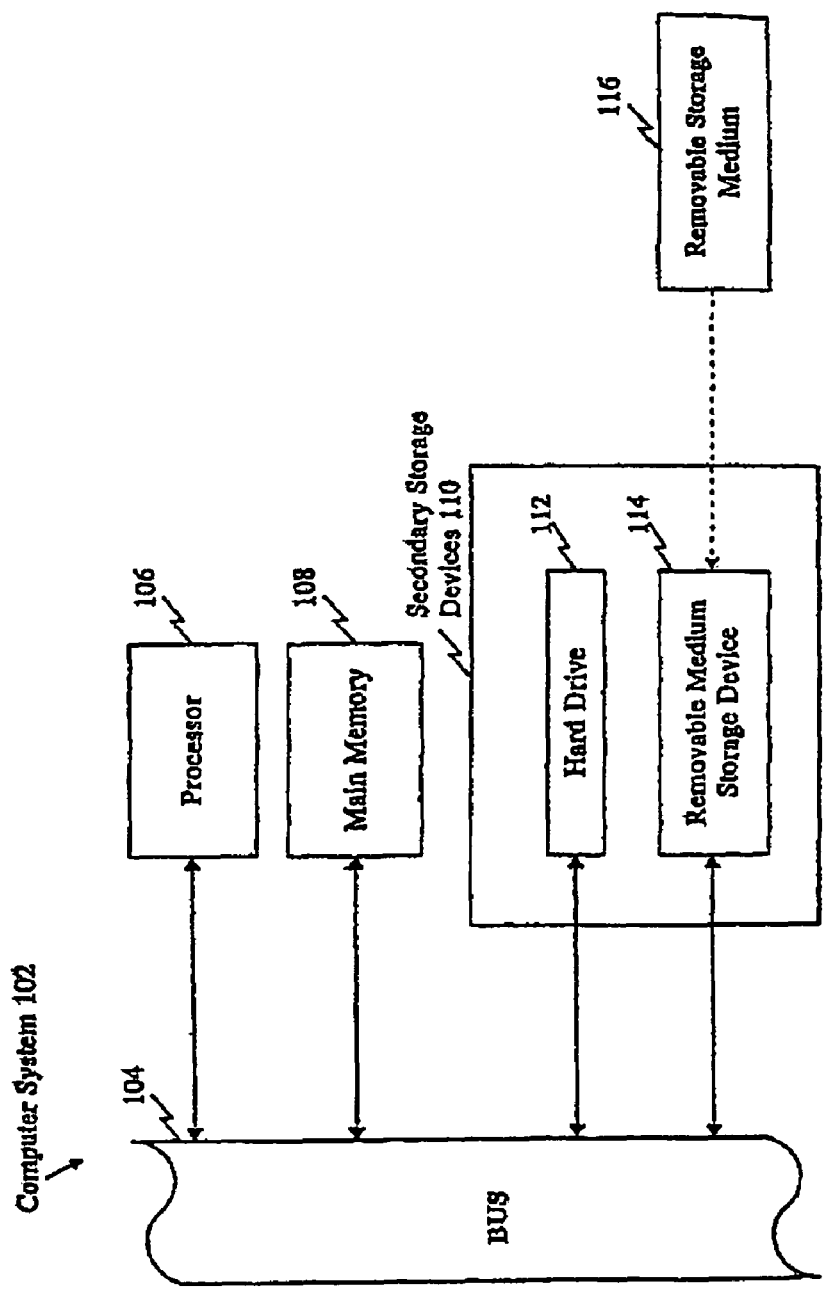
FIG. 1 provides a diagrammatic representation of a computer-based discovery system containing the SNP information of the present invention in computer readable form.

The present invention provides SNPs associated with CHD, and in particular stenosis and MI, nucleic acid molecules containing SNPs, methods and reagents for the detection of the SNPs disclosed herein, uses of these SNPs for the development of detection reagents, and assays or kits that utilize such reagents. The stenosis or MI-associated SNPs disclosed herein are useful for diagnosing, screening for, and evaluating predisposition to stenosis or MI and related pathologies in humans. Furthermore, such SNPs and their encoded products are useful targets for the development of therapeutic agents.

A large number of SNPs have been identified from re-sequencing DNA from 39 individuals, and they are indicated as "Applera" SNP source in Tables 1-2. Their allele frequencies observed in each of the Caucasian and African-American ethnic groups are provided. Additional SNPs included herein were previously identified during shotgun sequencing and assembly of the human genome, and they are indicated as "Celera" SNP source in Tables 1-2. Furthermore, the information provided in Table 1-2, particularly the allele frequency information obtained from 39 individuals and the identification of the precise position of each SNP within each gene/transcript, allows haplotypes (i.e., groups of SNPs that are co-inherited) to be readily inferred. The present invention encompasses SNP haplotypes, as well as individual SNPs.

Thus, the present invention provides individual SNPs associated with CHD, and in particular stenosis and MI, as well as combinations of SNPs and haplotypes in genetic regions associated with CHD, and in particular stenosis and MI, polymorphic/variant transcript sequences (SEQ ID NOS: 1-67) and genomic sequences (SEQ ID NOS: 229-299) containing SNPs, encoded amino acid sequences (SEQ ID NOS: 68-134), and both transcript-based SNP context sequences (SEQ ID NOS: 135-228) and genomic-based SNP context sequences (SEQ ID NOS: 300-504) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining the risk of an individual of having or developing stenosis and/or MI, methods of screening for compounds useful for treating disorders associated with a variant gene/protein such as stenosis or MI, compounds identified by these screening methods, methods of using the disclosed SNPs to select a treatment strategy, methods of treating a disorder associated with a variant gene/protein (i.e., therapeutic methods), methods of determining if an individual is likely to respond to a specific treatment such as statins and methods of using the SNPs of the present invention for human identification.

The present invention provides novel SNPs associated with stenosis and/or MI, as well as SNPs that were previously known in the art, but were not previously known to be associated with stenosis or MI. Accordingly, the present invention provides novel compositions and methods based on the novel SNPs disclosed herein, and also provides novel methods of using the known, but previously unassociated, SNPs in methods relating to stenosis or MI (e.g., for diagnosing MI, etc.). In Tables 1-2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD). Novel SNPs for which the SNP source is only "Applera" and none other, i.e., those that have not been observed in any public databases and which were also not observed during shotgun sequencing and assembly of the Celera human genome sequence (i.e., "Celera" SNP source), are also noted in the tables.

Particular SNP alleles of the present invention can be associated with either an increased risk of having or developing stenosis or MI, or a decreased risk of having or developing stenosis or MI. SNP alleles that are associated with a decreased risk of having or developing stenosis or MI may be referred to as "protective" alleles, and SNP alleles that are associated with an increased risk of having or developing stenosi or MI may be referred to as "susceptibility" alleles, "risk" alleles, or "risk factors". Thus, whereas certain SNPs (or their encoded products) can be assayed to determine whether an individual possesses a SNP allele that is indicative of an increased risk of having or developing stenosis or MI (i.e., a susceptibility allele), other SNPs (or their encoded products) can be assayed to determine whether an individual possesses a SNP allele that is indicative of a decreased risk of having or developing stenosis or MI (i.e., a protective allele). Similarly, particular SNP alleles of the present invention can be associated with either an increased or decreased likelihood of responding to a particular treatment or therapeutic compound, or an increased or decreased likelihood of experiencing toxic effects from a particular treatment or therapeutic compound. The term "altered" may be used herein to encompass either of these two possibilities (e.g., an increased or a decreased risk/likelihood).

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/protein (the art-known protein may be interchangeably referred to as the "wild-type," "reference," or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation, i.e., a SNP that creates a premature stop codon, a SNP that generates a read-through mutation by abolishing a stop codon, or due to any SNP disclosed by the present invention that otherwise alters the structure, function/activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide," "peptide," and "protein" are used interchangeably.

Isolated Nucleic Acid Molecules and SNP Detection Reagents & Kits

Tables 1 and 2 provide a variety of information about each SNP of the present invention that is associated with CHD, and in particular stenosis and MI, including the transcript sequences (SEQ ID NOS: 1-67), genomic sequences (SEQ ID NOS: 229-299), and protein sequences (SEQ ID NOS: 68-134) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS: 135-228 correspond to transcript-based SNP context sequences disclosed in Table 1, and SEQ ID NOS: 300-504 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

The present invention provides isolated nucleic acid molecules that contain one or more SNPs disclosed Table 1 and/or Table 2. Isolated nucleic acid molecules containing one or more SNPs disclosed in at least one of Tables 1-2 may be interchangeably referred to throughout the present text as "SNP-containing nucleic acid molecules". Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated". Nucleic acid molecules present in non-human transgenic animals, which do not naturally occur in the animal, are also considered "isolated". For example, recombinant DNA molecules contained in a vector are considered "isolated". Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances, the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are referred to in Table 1 and provided in the Sequence Listing (SEQ ID NOS: 1-67), and polymorphic genomic sequences are referred to in Table 2 and provided in the Sequence Listing (SEQ ID NOS: 229-299). Furthermore, fragments of such full-length genes and transcripts that contain one or more SNPs disclosed herein are also encompassed by the present invention, and such fragments may be used, for example, to express any part of a protein, such as a particular functional domain or an antigenic epitope.

Thus, the present invention also encompasses fragments of the nucleic acid sequences as disclosed in Tables 1-2 (transcript sequences are referred to in Table 1 as SEQ ID NOS: 1-67, genomic sequences are referred to in Table 2 as SEQ ID NOS: 229-299, transcript-based SNP context sequences are referred to in Table 1 as SEQ ID NO: 135-228, and genomic-based SNP context sequences are referred to in Table 2 as SEQ ID NO: 300-504) and their complements. The actual sequences referred to in the tables are provided in the Sequence Listing. A fragment typically comprises a contiguous nucleotide sequence at least about 8 or more nucleotides, more preferably at least about 12 or more nucleotides, and even more preferably at least about 16 or more nucleotides. Further, a fragment could comprise at least about 18, 20, 22, 25, 30, 40, 50, 60, 80, 100, 150, 200, 250 or 500 (or any other number in-between) nucleotides in length. The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195; and 4,683,202; *PCR Technology: Principles and Applications for DNA Amplification*, ed. H. A. Erlich, Freeman Press, NY, N.Y., 1992), ligase chain reaction (LCR) (Wu and Wallace, *Genomics* 4:560, 1989; Landegren et al., *Science* 241:1077, 1988), strand displacement amplification (SDA) (U.S. Pat. Nos. 5,270,184; and 5,422,252), transcription-mediated amplification (TMA) (U.S. Pat. No. 5,399,491), linked linear amplification (LLA) (U.S. Pat. No. 6,027,923), and the like, and isothermal amplification methods such as nucleic acid sequence based amplification (NASBA), and self-sustained sequence replication (Guatelli et al., *Proc. Natl. Acad. Sci. USA* 87: 1874, 1990). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten fold, fifty fold, one hundred fold, one thousand fold, or even ten thousand fold increase as compared to its starting amount in a test sample. In a typical PCR amplification, a polynucleotide of interest is often amplified at least fifty thousand fold in amount over the unamplified genomic DNA, but the precise amount of amplification needed for an assay depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotides in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1-2. Such a product may have additional sequences on its 5' end or 3' end or both. In another embodiment, the amplified product is about 101 nucleotides in length, and it contains a SNP disclosed herein. Preferably, the SNP is located at the middle of the amplified product (e.g. at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product (however, as indicated above, the SNP of interest may be located anywhere along the length of the amplified product).

The present invention provides isolated nucleic acid molecules that comprise, consist of, or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are referred to in Table 1 as SEQ ID NOS: 1-67, genomic sequences are referred to in Table 2 as SEQ ID NOS: 229-299, transcript-based SNP context sequences are referred to in Table 1 as SEQ ID NO: 135-228, and genomic-based SNP context sequences are referred to in Table 2 as SEQ ID NO: 300-504), or any nucleic acid molecule that encodes any of the variant proteins referred to in Table 1 (SEQ ID NOS: 68-134). The actual sequences referred to in the tables are provided in the Sequence Listing. A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences referred to in Table 1 and/or Table 2 (transcript sequences are referred to in Table 1 as SEQ ID NOS:1-67, genomic sequences are referred to in Table 2 as SEQ ID NOS: 229-299, transcript-based SNP context sequences are referred to in Table 1 as SEQ ID NO: 135-228, and genomic-based SNP context sequences are referred to in Table 2 as SEQ ID NO: 300-504), or any nucleic acid molecule that encodes any of the variant proteins referred to in Table 1 (SEQ ID NOS: 68-134). The actual sequences referred to in the tables are provided in the Sequence Listing. A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are referred to in Table 1 as SEQ ID NOS: 1-67, genomic sequences are referred to in Table 2 as SEQ ID NOS: 229-299, transcript-based SNP context sequences are referred to in Table 1 as SEQ ID NO: 135-228, and genomic-based SNP context sequences are referred to in Table 2 as SEQ ID NO: 300-504), or any nucleic acid molecule that encodes any of the variant proteins provided in Table 1 (SEQ ID NOS: 147-292). The actual sequences referred to in the tables are provided in the Sequence Listing. A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art (Sambrook and Russell, 2000, Molecular Cloning: A Laboratory Manual, Cold Spring Harbor Press, NY).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof (Sambrook and Russell, 2000, Molecular Cloning: A Laboratory Manual, Cold Spring Harbor Press, NY). Furthermore, isolated nucleic acid molecules, particularly SNP detection reagents such as probes and primers, can also be partially or completely in the form of one or more types of nucleic acid analogs, such as peptide nucleic acid (PNA) (U.S. Pat. Nos. 5,539,082; 5,527,675; 5,623,049; 5,714,331). The nucleic acid, especially DNA, can be double-stranded or single-stranded. Single-stranded nucleic acid can be the coding strand (sense strand) or the complementary non-coding strand (anti-sense strand). DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art (see, e.g., Corey, "Peptide nucleic acids: expanding the scope of nucleic acid recognition", *Trends Biotechnol*. 1997 June; 15(6):224-9, and Hyrup et al., "Peptide nucleic acids (PNA): synthesis, properties and potential applications", *Bioorg Med. Chem.* 1996 January; 4(1):5-23). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2. Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone (Lagriffoul et al., Bioorganic & Medicinal Chemistry Letters, 4: 1081-1082 (1994), Petersen et al., Bioorganic & Medicinal Chemistry Letters, 6: 793-796 (1996), Kumar et al., Organic Letters 3(9): 1269-1272 (2001), WO96/04000). PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1-2). Variation can occur in either or both the coding and non-coding regions. The variations can produce conservative and/or non-conservative amino acid substitutions.

Further variants of the nucleic acid molecules disclosed in Tables 1-2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences referred to and shown in Tables 1-2, and can encode a polypeptide that varies to some degree from the specific polypeptide sequences referred to in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. (*Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part* 1, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991). In a preferred embodiment, the percent identity between two amino acid sequences is determined using the Needleman and Wunsch algorithm (*J. Mol. Biol.* (48):444-453 (1970)) which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

In yet another preferred embodiment, the percent identity between two nucleotide sequences is determined using the GAP program in the GCG software package (Devereux, J., et al., *Nucleic Acids Res.* 12(1):387 (1984)), using a NWSgapdna CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases to, for example, identify other family members or related sequences. Such searches can be performed using the NBLAST and XBLAST programs (version 2.0) of Altschul, et al. (*J. Mol. Biol.* 215: 403-10 (1990)). BLAST nucleotide searches can be performed with the NTBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (*Nucleic Acids Res.* 25(17):3389-3402 (1997)). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearson, *Methods Mol. Biol.* 25, 365-389 (1994)) and KERR (Dufresne et al., *Nat Biotechnol* 2002 December; 20(12):1269-71). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents In a specific aspect of the present invention, the SNPs disclosed in Table 1 and/or Table 2, and their associated transcript sequences (referred to in Table 1 as SEQ ID NOS: 1-67), genomic sequences (referred to in Table 2 as SEQ ID NOS: 229-299), and context sequences (transcript-based context sequences are referred to in Table 1 as SEQ ID NOS: 135-228; genomic-based context sequences are provided in Table 2 as SEQ ID NOS: 300-504), can be used for the design of SNP detection reagents. The actual sequences referred to in the tables are provided in the Sequence Listing. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs referred to in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences referred to in Table 1 and/or Table 2 (transcript-based context sequences are referred to in Table 1 as SEQ ID NOS: 135-228; genomic-based context sequences are referred to in Table 2 as SEQ ID NOS: 300-504). Another example of a detection reagent is a primer that acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g., probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily determined using the transcript sequences (SEQ ID NOS: 1-67), genomic sequences (SEQ ID NOS: 229-299), and SNP context sequences (transcript-based context sequences are referred to in Table 1 as SEQ ID NOS: 135-228; genomic-based context sequences are referred to in Table 2 as SEQ ID NOS: 300-504) disclosed in the Sequence Listing and in Tables 1-2. The actual sequences referred to in the tables are provided in the Sequence Listing. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm that starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides that detect single nucleotide variations in target sequences may be referred to by such terms as "allele-specific oligonucleotides", "allele-specific probes", or "allele-specific primers". The design and use of allele-specific probes for analyzing polymorphisms is described in, e.g., *Mutation Detection A Practical Approach*, ed. Cotton et al. Oxford University Press, 1998; Saiki et al, *Nature* 324, 163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: prehybridization with a solution containing 5× standard saline phosphate EDTA (SSPE), 0.5% NaDodSO$_4$ (SDS) at 55° C., and incubating probe with target nucleic acid molecules in the same solution at the same temperature, followed by washing with a solution containing 2×SSPE, and 0.1% SDS at 55° C. or room temperature.

Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes can be designed that hybridize to a segment of target DNA from one individual but do not hybridize to the corresponding segment from another individual due to the presence of different polymorphic forms (e.g., alternative SNP alleles/nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment that is particularly suitable for use in a oligonucleotide ligation assay (U.S. Pat. No. 4,988,617), the 3' most nucleotide of the probe aligns with the SNP position in the target sequence.

Oligonucleotide probes and primers may be prepared by methods well known in the art.

Chemical synthetic methods include, but are limited to, the phosphotriester method described by Narang et al., 1979, Methods in Enzymology 68:90; the phosphodiester method described by Brown et al., 1979, Methods in Enzymology 68:109, the diethylphosphoamidate method described by Beaucage et al., 1981, *Tetrahedron Letters* 22:1859; and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity (Gibbs, 1989, *Nucleic Acid Res.* 17 2427-2448). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention. Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210,015 and 5,538,848) or Molecular Beacon probe (U.S. Pat. Nos. 5,118, 801 and 5,312,728), or other stemless or linear beacon probe (Livak et al., 1995, PCR Method Appl. 4:357-362; Tyagi et al., 1996, Nature Biotechnology 14: 303-308; Nazarenko et al., 1997, Nucl. Acids Res. 25:2516-2521; U.S. Pat. Nos. 5,866,336 and 6,117,635).

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems", as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g., TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g., a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays," "microarrays," and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in U.S. Pat. No. 5,837,832, Chee et al., PCT application WO95/11995 (Chee et al.), Lockhart, D. J. et al. (1996; *Nat. Biotech.* 14: 1675-1680) and Schena, M. et al. (1996; *Proc. Natl. Acad. Sci.* 93: 10614-10619), all of which are incorporated herein in their entirety by reference. In other embodiments, such arrays are produced by the methods described by Brown et al., U.S. Pat. No. 5,807,522.

Nucleic acid arrays are reviewed in the following references: Zammatteo et al., "New chips for molecular biology and diagnostics", *Biotechnol Annu Rev.* 2002; 8:85-101; Sosnowski et al., "Active microelectronic array system for DNA hybridization, genotyping and pharmacogenomic applications", *Psychiatr Genet.* 2002 December; 12(4):181-92; Heller, "DNA microarray technology: devices, systems, and applications", *Annu Rev Biomed Eng.* 2002; 4:129-53. Epub 2002 Mar. 22; Kolchinsky et al., "Analysis of SNPs and other genomic variations using gel-based chips", *Hum Mutat.* 2002 April; 19(4):343-60; and McGall et al., "High-density gene-chip oligonucleotide probe arrays", *Adv Biochem Eng Biotechnol.* 2002; 77:21-42.

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, *Current Protocols in Molecular Biology*, John Wiley & Sons, N.Y. (1989), 6.3.1-6.3.6.

In other embodiments, the arrays are used in conjunction with chemiluminescent detection technology. The following patents and patent applications, which are all hereby incorporated by reference, provide additional information pertaining to chemiluminescent detection: U.S. patent application Ser. Nos. 10/620,332 and 10/620,333 describe chemiluminescent approaches for microarray detection; U.S. Pat. Nos. 6,124,478, 6,107,024, 5,994,073, 5,981,768, 5,871,938, 5,843,681, 5,800,999, and 5,773,628 describe methods and compositions of dioxetane for performing chemiluminescent detection; and U.S. published application US2002/0110828 discloses methods and compositions for microarray controls.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an ink jet application apparatus, as described in PCT application W095/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, V, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells), biopsies, buccal swabs or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM™ 6700 sample preparation system, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art (see, e.g., Weigl et al., "Lab-on-a-chip for drug development", *Adv Drug Deliv Rev.* 2003 Feb. 24; 55(3):349-77). In such microfluidic devices, the containers may be referred to as, for example, microfluidic "compartments", "chambers", or "channels".

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micro-machined channels and to change the liquid flow rate for pumping across different sections of the microchip. See, for example, U.S. Pat. No. 6,153,073, Dubrow et al., and U.S. Pat. No. 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic Acid Molecules

The nucleic acid molecules of the present invention have a variety of uses, especially in the diagnosis and treatment of CHD, and in particular stenosis and MI. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule referred to in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations (Sambrook and Russell, 2000, Molecular Cloning: A Laboratory Manual, Cold Spring Harbor Press, Cold Spring Harbor, N.Y.).

Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining whether an individual with the polymorphisms is at risk for stenosis or MI or has developed early stage stenosis or MI. Detection of a SNP associated with a disease phenotype provides a diagnostic tool for an active disease and/or genetic predisposition to the disease.

Furthermore, the nucleic acid molecules of the invention are therefore useful for detecting a gene (gene information is disclosed in Table 2, for example) which contains a SNP disclosed herein and/or products of such genes, such as expressed mRNA transcript molecules (transcript information is disclosed in Table 1, for example), and are thus useful for detecting gene expression. The nucleic acid molecules can optionally be implemented in, for example, an array or kit format for use in detecting gene expression.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences referred to in Table 1. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides. The production of recombinant cells and transgenic animals having nucleic acid molecules which contain the SNPs disclosed in Table 1 and/or Table 2 allow, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which specific nucleotide (i.e., allele) is present at each of one or more SNP positions, such as a SNP position in a nucleic acid molecule disclosed in Table 1 and/or Table 2, is referred to as SNP genotyping. The present invention provides methods of SNP genotyping, such as for use in screening for CHD, and in particular stenosis and MI, or related pathologies, or determining predisposition thereto, or determining responsiveness to a form of treatment, or in genome mapping or SNP association analysis, etc.

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput", *Pharmacogenomics J.* 2003; 3(2):77-96; Kwok et al., "Detection of single nucleotide polymorphisms", *Curr Issues Mol Biol.* 2003 April; 5(2):43-60; Shi, "Technologies for individual genotyping: detection of genetic polymorphisms in drug targets and disease genes", *Am J Pharmacogenomics.* 2002; 2(3):197-205; and Kwok, "Methods for genotyping single nucleotide polymorphisms", *Annu Rev Genomics Hum Genet* 2001; 2:235-58. Exemplary techniques for high-throughput SNP genotyping are described in Marnellos, "High-throughput SNP analysis for genetic association studies", *Curr Opin Drug Discov Devel.* 2003 May; 6(3):317-21. Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay. Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et al., *Science* 230:1242 (1985); Cotton et al., *PNAS* 85:4397 (1988); and Saleeba et al., *Meth. Enzymol.* 217:286-295 (1992)), comparison of the electrophoretic mobility of variant and wild type nucleic acid molecules (Orita et al., *PNAS* 86:2766 (1989); Cotton et al., *Mutat. Res.* 285:125-144 (1993); and Hayashi et al., *Genet. Anal. Tech. Appl.* 9:73-79 (1992)), and assaying the movement of polymorphic or wild-type fragments in polyacrylamide gels containing a gradient of denaturant using denaturing gradient gel electrophoresis (DGGE) (Myers et al., *Nature* 313:495 (1985)). Sequence variations at specific locations can also be assessed by nuclease protection assays such as RNase and S1 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in diagnostic assays for CHD, and in particular stenosis and MI and related pathologies, and can be readily incorporated into a kit format. The present invention also includes modifications of the Taqman assay well known in the art such as the use of Molecular Beacon probes (U.S. Pat. Nos. 5,118,801 and 5,312,728) and other variant formats (U.S. Pat. Nos. 5,866,336 and 6,117,635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA: U.S. Pat. Nos. 6,027,889, 6,268,148, 5,494,810, 5,830,711, and 6,054,564 describe OLA strategies for performing SNP detection; WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array; U.S. application Ser. Nos. 01/17329 (and 09/584,905) describes OLA (or LDR) followed by PCR, wherein zipcodes are incorporated into OLA probes, and amplified PCR products are determined by electrophoretic or universal zipcode array readout; U.S. applications 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPs) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry", *Rapid Commun Mass Spectrom.* 2003; 17(11): 1195-202.

The following references provide further information describing mass spectrometry-based methods for SNP genotyping: Bocker, "SNP and mutation discovery using base-specific cleavage and MALDI-TOF mass spectrometry", *Bioinformatics.* 2003 July; 19 Suppl 1:144-153; Storm et al., "MALDI-TOF mass spectrometry-based SNP genotyping", *Methods Mol. Biol.* 2003; 212:241-62; Jurinke et al., "The use of Mass ARRAY technology for high throughput genotyping", *Adv Biochem Eng Biotechnol.* 2002; 77:57-74; and Jurinke et al., "Automated genotyping using the DNA MassArray technology", *Methods Mol. Biol.* 2002; 187:179-92.

SNPs can also be scored by direct DNA sequencing. A variety of automated sequencing procedures can be utilized ((1995) *Biotechniques* 19:448), including sequencing by mass spectrometry (see, e.g., PCT International Publication No. WO94/16101; Cohen et al., *Adv. Chromatogr.* 36:127-162 (1996); and Griffin et al., *Appl. Biochem. Biotechnol.* 38:147-159 (1993)). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730x1 DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE) (Myers et al., *Nature* 313:495 (1985)). SSCP identifies base differences by alteration in electrophoretic migration of single stranded PCR products, as described in Orita et al., *Proc. Nat. Acad.* Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel (Erlich, ed., PCR Technology, *Principles and Applications for DNA Amplification*, W.H. Freeman and Co, New York, 1992, Chapter 7).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying a patient population for clinical trial for a treatment regimen, predicting the likelihood that an individual will experience toxic side effects from a therapeutic agent, and human identification applications such as forensics.

Analysis of Genetic Association Between SNPs and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies (*Modern Epidemiology*, Lippincott Williams & Wilkins (1998), 609-622). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

In both types of observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-squared tests and t-tests (Wilcoxon ranksum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease (*Genetic Data Analysis*, Weir B., Sinauer (1990)).

To test whether an allele of a single SNP is associated with the case or control status of a phenotypic trait, one skilled in the art can compare allele frequencies in cases and controls. Standard chi-squared tests and Fisher exact tests can be carried out on a 2×2 table (2 SNP alleles×2 outcomes in the categorical trait of interest). To test whether genotypes of a SNP are associated, chi-squared tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95%.

In order to control for confounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions) (Applied Logistic Regression, Hosmer and Lemeshow, Wiley (2000)). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $r^2$, are typically calculated for the markers within a gene to elucidate the haplotype structure. Recent studies (Daly et al, *Nature Genetics*, 29, 232-235, 2001) in linkage disequilibrium indicate that SNPs within a gene are organized in block pattern, and a high degree of linkage disequilibrium exists within blocks and very little linkage disequilibrium exists between blocks. Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed (Schaid et al, *Am. J. Hum. Genet.*, 70, 425-434, 2002) that score tests can be done on haplotypes using the program "haplo.score." In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the P value of the tests reaches that level. In an exploratory analysis where positive hits will be followed up in subsequent confirmatory testing, an unadjusted P value<0.2 (a significance level on the lenient side), for example, may be used for generating hypotheses for significant association of a SNP with certain phenotypic characteristics of a disease. It is preferred that a p-value<0.05 (a significance level traditionally used in the art) is achieved in order for a SNP to be considered to have an association with a disease. It is more preferred that a p-value<0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wide error rates at 0.05. While there are different methods to adjust for multiple testing to control for different kinds of error rates, a commonly used but rather conservative method is Bonferroni correction to control the experiment-wise or family-wise error rate (*Multiple comparisons and multiple tests*, Westfall et al, SAS Institute (1999)). Permutation tests to control for the false discovery rates, FDR, can be more powerful (Benjamini and Hochberg, Journal of the Royal Statistical Society, Series B 57, 1289-1300, 1995, *Resampling-based Multiple Testing*, Westfall and Young, Wiley (1993)). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies (*Modern Epidemiology*, Lippincott Williams & Wilkins, 1998, 643-673). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies (Ewens and Spielman, *Am. J. Hum. Genet.* 62, 450-458, 1995) when prevalence of the disease is associated with different subpopulation groups. Such bias can also lead to a loss of statistical power in genetic association studies. To detect population stratification, Pritchard and Rosenberg (Pritchard et al. *Am. J. Hum. Gen.* 1999, 65:220-228) suggested typing markers that are unlinked to the disease and using results of association tests on those markers to determine whether there is any population stratification. When stratification is detected, the genomic control (GC) method as proposed by Devlin and Roeder (Devlin et al. *Biometrics* 1999, 55:997-1004) can be used to adjust for the inflation of test statistics due to population stratification. GC method is robust to changes in population structure levels as well as being applicable to DNA pooling designs (Devlin et al. *Genet. Epidem.* 20001, 21:273-284).

While Pritchard's method recommended using 15-20 unlinked microsatellite markers, it suggested using more than 30 biallelic markers to get enough power to detect population stratification. For the GC method, it has been shown (Bacanu et al. *Am. J. Hum. Genet.* 2000, 66:1933-1944) that about 60-70 biallelic markers are sufficient to estimate the inflation factor for the test statistics due to population stratification. Hence, 70 intergenic SNPs can be chosen in unlinked regions as indicated in a genome scan (Kehoe et al. *Hum. Mol. Genet.* 1999, 8:237-245).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks (*Applied Regression Analysis*, Draper and Smith, Wiley (1998)). Moreover, other techniques can also be used for setting up classification. Such techniques include, but are not limited to, MART, CART, neural network, and discriminant analyses that are suitable for use in comparing the performance of different methods (*The Elements of Statistical Learning*, Hastie, Tibshirani & Friedman, Springer (2002)).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the risk allele(s).

The SNPs of the invention may contribute to the development of CHD in an individual in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose," "diagnosis," and "diagnostics" include, but are not limited to any of the following: detection of CHD such as stenosis and MI that an individual may presently have, predisposition/susceptibility screening (i.e., determining the increased risk of an individual in developing stenosis or MI in the future, or determining whether an individual has a decreased risk of developing CHD in the future), determining a particular type or subclass of CHD in an individual known to have CHD, confirming or reinforcing a previously made diagnosis of CHD, pharmacogenomic evaluation of an individual to determine which therapeutic strategy that individual is most likely to positively respond to or to predict whether a patient is likely to respond to a particular treatment such as statins, predicting whether a patient is likely to experience toxic effects from a particular treatment or therapeutic compound, and evaluating the future prognosis of an individual having CHD. Such diagnostic uses are based on the SNPs individually or in a unique combination or SNP haplotypes of the present invention.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium." In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby. Hence, genotyping one of the SNP sites will give almost the same information as genotyping the other SNP site that is in LD.

Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic purposes and similar uses, if a particular SNP site is found to be useful for diagnosing CHD (e.g., has a significant statistical association with the condition and/or is recognized as a causative polymorphism for the condition), then the skilled artisan would recognize that other SNP sites which are in LD with this SNP site would also be useful for diagnosing the condition. Thus, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., CHD) that is influenced by the causative SNP(s). Therefore, polymorphic markers that are in LD with causative polymorphisms are useful as diagnostic markers, and are particularly useful when the actual causative polymorphism(s) is/are unknown.

Examples of polymorphisms that can be in LD with one or more causative polymorphisms (and/or in LD with one or more polymorphisms that have a significant statistical association with a condition) and therefore useful for diagnosing the same condition that the causative/associated SNP(s) is used to diagnose, include other SNPs in the same gene, protein-coding, or mRNA transcript-coding region as the causative/associated SNP, other SNPs in the same exon or same intron as the causative/associated SNP, other SNPs in the same haplotype block as the causative/associated SNP, other SNPs in the same intergenic region as the causative/associated SNP, SNPs that are outside but near a gene (e.g., within 6 kb on either side, 5' or 3', of a gene boundary) that harbors a causative/associated SNP, etc. Such useful LD SNPs can be selected from among the SNPs disclosed in Tables 1-2, for example.

Linkage disequilibrium in the human genome is reviewed in: Wall et al., "Haplotype blocks and linkage disequilibrium in the human genome", *Nat Rev Genet.* 2003 August; 4(8): 587-97; Garner et al., "On selecting markers for association studies: patterns of linkage disequilibrium between two and three diallelic loci", *Genet Epidemiol.* 2003 January; 24(1): 57-67; Ardlie et al., "Patterns of linkage disequilibrium in the human genome", *Nat Rev Genet.* 2002 April; 3(4):299-309 (erratum in *Nat Rev Genet* 2002 July; 3(7):566); and Remm et al., "High-density genotyping and linkage disequilibrium in the human genome using chromosome 22 as a model"; *Curr Opin Chem Biol.* 2002 February; 6(1):24-30; Haldane J B S (1919) The combination of linkage values, and the calculation of distances between the loci of linked factors. J Genet 8:299-309; Mendel, G. (1866) Versuche über Pflanzen-Hybriden. Verhandlungen des naturforschenden Vereines in Brünn [Proceedings of the Natural History Society of Brünn]; Lewin B (1990) *Genes IV*. Oxford University Press, New York, USA; Hartl D L and Clark A G (1989) *Principles of Population Genetics* $2^{nd}$ *ed*. Sinauer Associates, Inc. Sunderland, Mass., USA; Gillespie J H (2004) *Population Genetics: A Concise Guide.* $2^{nd}$ *ed*. Johns Hopkins University Press. USA; Lewontin R C (1964) The interaction of selection and linkage. I. General considerations; heterotic models. Genetics 49:49-67; Hoel P G (1954) *Introduction to Mathematical Statistics* $2^{nd}$ *ed*. John Wiley & Sons, Inc. New York, USA; Hudson R R (2001) Two-locus sampling distributions and their application. Genetics 159:1805-1817; Dempster A P, Laird N M, Rubin D B (1977) Maximum likelihood from incomplete data via the EM algorithm. J R Stat Soc 39:1-38; Excoffier L, Slatkin M (1995) Maximum-likelihood estimation of molecular haplotype frequencies in a diploid population. Mol Biol Evol 12(5):921-927; Tregouet D A, Escolano S, Tiret L, Mallet A, Golmard J L (2004) A new algorithm for haplotype-based association analysis: the Stochastic-EM algorithm. Ann Hum Genet 68(Pt 2):165-177; Long A D and Langley C H (1999) The power of association studies to detect the contribution of candidate genetic loci to variation in complex traits. Genome Research 9:720-731; Agresti A (1990) *Categorical Data Analysis*. John Wiley & Sons, Inc. New York, USA; Lange K (1997) Mathematical *and Statistical Methods for Genetic Analysis*. Springer-Verlag New York, Inc. New York, USA; The International HapMap Consortium (2003) The International HapMap Project. Nature 426:789-796; The International HapMap Consortium (2005) A haplotype map of the human genome. Nature 437:1299-1320; Thorisson G A, Smith A V, Krishnan L, Stein L D (2005), The International HapMap Project Web Site. Genome Research 15:1591-1593; McVean G, Spencer C C A, Chaix R (2005) Perspectives on human genetic variation from the HapMap project. PLoS Genetics 1(4):413-418; Hirschhorn J N, Daly M J (2005) Genome-wide association studies for common diseases and complex traits. Nat Genet 6:95-108; Schrodi S J (2005) A probabilistic approach to large-scale association scans: a semi-Bayesian method to detect disease-predisposing alleles. SAGMB 4(1):31; Wang W Y S, Barratt B J, Clayton D G, Todd J A (2005) Genome-wide association studies: theoretical and practical concerns. Nat Rev Genet 6:109-118. Pritchard J K, Przeworski M (2001) Linkage disequilibrium in humans: models and data. Am J Hum Genet 69:1-14.

As discussed above, one aspect of the present invention is the discovery that SNPs which are in certain LD distance with the interrogated SNP can also be used as valid markers for identifying an increased or decreased risks of having or developing CHD. As used herein, the term "interrogated SNP" refers to SNPs that have been found to be associated with an increased or decreased risk of disease using genotyping results and analysis, or other appropriate experimental method as exemplified in the working examples described in this application. As used herein, the term "LD SNP" refers to a SNP that has been characterized as a SNP associating with an increased or decreased risk of diseases due to their being in LD with the "interrogated SNP" under the methods of calculation described in the application. Below, applicants describe the methods of calculation with which one of ordinary skilled in the art may determine if a particular SNP is in LD with an interrogated SNP. The parameter $r^2$ is commonly used in the genetics art to characterize the extent of linkage disequilibrium between markers (Hudson, 2001). As used herein, the term "in LD with" refers to a particular SNP that is measured at above the threshold of a parameter such as $r^2$ with an interrogated SNP.

It is now common place to directly observe genetic variants in a sample of chromosomes obtained from a population. Suppose one has genotype data at two genetic markers located on the same chromosome, for the markers A and B. Further suppose that two alleles segregate at each of these two markers such that alleles $A_1$ and $A_2$ can be found at marker A and alleles $B_1$ and $B_2$ at marker B. Also assume that these two markers are on a human autosome. If one is to examine a specific individual and find that they are heterozygous at both markers, such that their two-marker genotype is $A_1A_2B_1B_2$, then there are two possible configurations: the individual in question could have the alleles $A_1B_1$ on one chromosome and $A_2B_2$ on the remaining chromosome; alternatively, the individual could have alleles $A_1B_2$ on one chromosome and $A_2B_1$ on the other. The arrangement of alleles on a chromosome is called a haplotype. In this illustration, the individual could have haplotypes $A_1B_1/A_2B_2$ or $A_1B_2/A_2B_1$ (see Hartl and Clark (1989) for a more complete description). The concept of linkage equilibrium relates the frequency of haplotypes to the allele frequencies.

Assume that a sample of individuals is selected from a larger population. Considering the two markers described above, each having two alleles, there are four possible haplotypes: $A_1B_1, A_1B_2, A_2B_1$ and $A_2B_2$. Denote the frequencies of these four haplotypes with the following notation.

$$P_{11} = \text{freq}(A_1B_1) \tag{1}$$

$$P_{12} = \text{freq}(A_1B_2) \tag{2}$$

$$P_{21} = \text{freq}(A_2B_1) \tag{3}$$

$$P_{22} = \text{freq}(A_2B_2) \tag{4}$$

The allele frequencies at the two markers are then the sum of different haplotype frequencies, it is straightforward to write down a similar set of equations relating single-marker allele frequencies to two-marker haplotype frequencies:

$$p_1 = \text{freq}(A_1) = P_{11} + P_{12} \tag{5}$$

$$p_2 = \text{freq}(A_2) = P_{21} + P_{22} \tag{6}$$

$$q_1 = \text{freq}(B_1) = P_{11} + P_{21} \tag{7}$$

$$q_2 = \text{freq}(B_2) = P_{12} + P_{22} \tag{8}$$

Note that the four haplotype frequencies and the allele frequencies at each marker must sum to a frequency of 1.

$$P_{11} + P_{12} + P_{21} + P_{22} = 1 \tag{9}$$

$$p_1 + p_2 = 1 \tag{10}$$

$$q_1 + q_2 = 1 \tag{11}$$

If there is no correlation between the alleles at the two markers, one would expect that the frequency of the haplotypes would be approximately the product of the composite alleles. Therefore, $$P_{11} \approx p_1 q_1 \tag{12}$$

$$P_{12} \approx p_1 q_2 \tag{13}$$

$$P_{21} \approx p_2 q_1 \tag{14}$$

$$P_{22} \approx p_2 q_2 \tag{15}$$

These approximating equations (12)-(15) represent the concept of linkage equilibrium where there is independent assortment between the two markers—the alleles at the two markers occur together at random. These are represented as approximations because linkage equilibrium and linkage disequilibrium are concepts typically thought of as properties of a sample of chromosomes; and as such they are susceptible to stochastic fluctuations due to the sampling process. Empirically, many pairs of genetic markers will be in linkage equilibrium, but certainly not all pairs.

Having established the concept of linkage equilibrium above, applicants can now describe the concept of linkage disequilibrium (LD), which is the deviation from linkage equilibrium. Since the frequency of the $A_1B_1$ haplotype is approximately the product of the allele frequencies for $A_1$ and $B_1$ under the assumption of linkage equilibrium as stated mathematically in (12), a simple measure for the amount of departure from linkage equilibrium is the difference in these two quantities, D, $$D = P_{11} - p_1 q_1 \tag{16}$$

D=0 indicates perfect linkage equilibrium. Substantial departures from D=0 indicates LD in the sample of chromosomes examined. Many properties of D are discussed in Lewontin (1964) including the maximum and minimum values that D can take. Mathematically, using basic algebra, it can be shown that D can also be written solely in terms of haplotypes:

$$D = P_{11}P_{22} - P_{12}P_{21} \tag{17}$$

If one transforms D by squaring it and subsequently dividing by the product of the allele frequencies of $A_1, A_2, B_1$ and $B_2$, the resulting quantity, called $r^2$, is equivalent to the square of the Pearson's correlation coefficient commonly used in statistics (e.g. Hoel, 1954).

$$r^2 = \frac{D^2}{p_1 p_2 q_1 q_2} \tag{18}$$

As with D, values of $r^2$ close to 0 indicate linkage equilibrium between the two markers examined in the sample set. As values of $r^2$ increase, the two markers are said to be in linkage disequilibrium. The range of values that $r^2$ can take are from 0 to 1. $r^2=1$ when there is a perfect correlation between the alleles at the two markers.

In addition, the quantities discussed above are sample-specific. And as such, it is necessary to formulate notation specific to the samples studied. In the approach discussed here, three types of samples are of primary interest: (i) a sample of chromosomes from individuals affected by a disease-related phenotype (cases), (ii) a sample of chromosomes obtained from individuals not affected by the disease-related phenotype (controls), and (iii) a standard sample set used for the construction of haplotypes and calculation pairwise linkage disequilibrium. For the allele frequencies used in the development of the method described below, an additional subscript will be added to denote either the case or control sample sets.

$$p_{1,cs} = \text{freq}(A_1 \text{ in cases}) \tag{19}$$

$$p_{2,cs} = \text{freq}(A_2 \text{ in cases}) \tag{20}$$

$$q_{1,cs} = \text{freq}(B_1 \text{ in cases}) \tag{21}$$

$$q_{2,cs} = \text{freq}(B_2 \text{ in cases}) \tag{22}$$

Similarly, $$p_{1,ct} = \text{freq}(A_1 \text{ in controls}) \tag{23}$$

$$p_{2,ct} = \text{freq}(A_2 \text{ in controls}) \tag{24}$$

$$q_{1,ct} = \text{freq}(B_1 \text{ in controls}) \tag{25}$$

$$q_{2,ct} = \text{freq}(B_2 \text{ in controls}) \tag{26}$$

As a well-accepted sample set is necessary for robust linkage disequilibrium calculations, data obtained from the International HapMap project (The International HapMap Consortium 2003, 2005; Thorisson et al, 2005; McVean et al, 2005) can be used for the calculation of pairwise $r^2$ values. Indeed, the samples genotyped for the International HapMap Project were selected to be representative examples from various human sub-populations with sufficient numbers of chromosomes examined to draw meaningful and robust conclusions from the patterns of genetic variation observed. The International HapMap project website (hapmap.org) contains a description of the project, methods utilized and samples examined. It is useful to examine empirical data to get a sense of the patterns present in such data.

Haplotype frequencies were explicit arguments in equation (18) above. However, knowing the 2-marker haplotype frequencies requires that phase to be determined for doubly heterozygous samples. When phase is unknown in the data examined, various algorithms can be used to infer phase from the genotype data. This issue was discussed earlier where the doubly heterozygous individual with a 2-SNP genotype of $A_1A_2B_1B_2$ could have one of two different sets of chromosomes: $A_1B_1/A_2B_2$ or $A_1B_2/A_2B_1$. One such algorithm to estimate haplotype frequencies is the expectation-maximization (EM) algorithm first formalized by Dempster et al (1977). This algorithm is often used in genetics to infer haplotype frequencies from genotype data (e.g. Excoffier and Slatkin, 1995; Tregouet et al, 2004). It should be noted that for the two-SNP case explored here, EM algorithms have very little error provided that the allele frequencies and sample sizes are not too small. The impact on $r^2$ values is typically negligible.

As correlated genetic markers share information, interrogation of SNP markers in LD with a disease-associated SNP marker can also have sufficient power to detect disease association (Long and Langley, 1999). The relationship between the power to directly find disease-associated alleles and the power to indirectly detect disease-association was investigated by Pritchard and Przeworski (2001). In a straight-forward derivation, it can be shown that the power to detect disease association indirectly at a marker locus in linkage disequilibrium with a disease-association locus is approximately the same as the power to detect disease-association directly at the disease-association locus if the sample size is increased by a factor of $$\frac{1}{r^2}$$

(the reciprocal of equation 18) at the marker in comparison with the disease-association locus.

Therefore, if one calculated the power to detect disease-association indirectly with an experiment having N samples, then equivalent power to directly detect disease-association (at the actual disease-susceptibility locus) would necessitate an experiment using approximately $r^2N$ samples. This elementary relationship between power, sample size and linkage disequilibrium can be used to derive an $r^2$ threshold value useful in determining whether or not genotyping markers in linkage disequilibrium with a SNP marker directly associated with disease status has enough power to indirectly detect disease-association.

To commence a derivation of the power to detect disease-associated markers through an indirect process, define the effective chromosomal sample size as $$n = \frac{4N_{cs}N_{ct}}{N_{cs}+N_{ct}}; \quad (27)$$

where $N_{cs}$ and $N_{ct}$ are the numbers of diploid cases and controls, respectively. This is necessary to handle situations where the numbers of cases and controls are not equivalent. For equal case and control sample sizes, $N_{cs}=N_{ct}=N$, the value of the effective number of chromosomes is simply $n=2N$—as expected. Let power be calculated for a significance level α (such that traditional P-values below α will be deemed statistically significant). Define the standard Gaussian distribution function as $\Phi(\cdot)$. Mathematically, $$\Phi(x) = \frac{1}{\sqrt{2\pi}} \int_{-\infty}^{x} e^{-\frac{\theta^2}{2}} d\theta \quad (28)$$

Alternatively, the following error function notation (Erf) may also be used, $$\Phi(x) = \frac{1}{2}\left[1 + \text{Erf}\left(\frac{x}{\sqrt{2}}\right)\right] \quad (29)$$

For example, $\Phi(1.644854)=0.95$. The value of $r^2$ may be derived to yield a pre-specified minimum amount of power to detect disease association though indirect interrogation. Noting that the LD SNP marker could be the one that is carrying the disease-association allele, therefore that this approach constitutes a lower-bound model where all indirect power results are expected to be at least as large as those interrogated.

Denote by β the error rate for not detecting truly disease-associated markers. Therefore, 1−β is the classical definition of statistical power. Substituting the Pritchard-Pzreworski result into the sample size, the power to detect disease association at a significance level of α is given by the approximation $$1-\beta \cong \Phi\left[\frac{|q_{1,cs}-q_{1,ct}|}{\sqrt{\frac{q_{1,cs}(1-q_{1,cs})+q_{1,ct}(1-q_{1,ct})}{r^2 n}}} - Z_{1-\frac{\alpha}{2}}\right]; \quad (30)$$

where $Z_u$ is the inverse of the standard normal cumulative distribution evaluated at u (u∈(0,1)). $Z_u=\Phi^{-1}(u)$, where $\Phi(\Phi^{-1}(u))=\Phi^{-1}(\Phi(u))=u$. For example, setting α=0.05, and therefore 1−α/2=0.975, we obtain $Z_{0.975}=1.95996$. Next, setting power equal to a threshold of a minimum power of T, $$T = \Phi\left[\frac{|q_{1,cs}-q_{1,ct}|}{\sqrt{\frac{q_{1,cs}(1-q_{1,cs})+q_{1,ct}(1-q_{1,ct})}{r^2 n}}} - Z_{1-\alpha/2}\right] \quad (31)$$

and solving for $r^2$, the following threshold $r^2$ is obtained:

$$r_T^2 = \frac{[q_{1,cs}(1-q_{1,cs})+q_{1,ct}(1-q_{1,ct})]}{n(q_{1,cs}-q_{1,ct})^2}\left[\Phi^{-1}(T)+Z_{1-\frac{\alpha}{2}}\right] \quad (32)$$

Or, $$r_T^2 = \left(\frac{Z_T+Z_{1-\frac{\alpha}{2}}}{n}\right)\left[\frac{q_{1,cs}-(q_{1,cs})^2+q_{1,ct}-(q_{1,ct})^2}{(q_{1,cs}-q_{1,ct})^2}\right] \quad (33)$$

Suppose that $r^2$ is calculated between an interrogated SNP and a number of other SNPs with varying levels of LD with the interrogated SNP. The threshold value $r_T^2$ is the minimum value of linkage disequilibrium between the interrogated SNP and the potential LD SNPs such that the LD SNP still retains a power greater or equal to T for detecting disease-association. For example, suppose that SNP rs200 is genotyped in a case-control disease-association study and it is found to be associated with a disease phenotype. Further suppose that the minor allele frequency in 1,000 case chromosomes was found to be 16% in contrast with a minor allele frequency of 10% in 1,000 control chromosomes. Given those measurements one could have predicted, prior to the experiment, that the power to detect disease association at a significance level of 0.05 was quite high—approximately 98% using a test of allelic association. Applying equation (32) one can calculate a minimum value of $r^2$ to indirectly assess disease association assuming that the minor allele at SNP rs200 is truly disease-predisposing for a threshold level of power. If one sets the threshold level of power to be 80%, then $r_T^2=0.489$ given the same significance level and chromosome numbers as above. Hence, any SNP with a pairwise $r^2$ value with rs200 greater than 0.489 is expected to have greater than 80% power to detect the disease association. Further, this is assuming the conservative model where the LD SNP is disease-associated only through linkage disequilibrium with the interrogated SNP rs200.

The contribution or association of particular SNPs and/or SNP haplotypes with disease phenotypes, such as CHD, enables the SNPs of the present invention to be used to develop superior diagnostic tests capable of identifying individuals who express a detectable trait, such as CHD, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with CHD might indicate a probability of 20% that an individual has or is at risk of developing CHD, whereas detection of five SNPs, each of which correlates with CHD, might indicate a probability of 80% that an individual has or is at risk of developing CHD. To further increase the accuracy of diagnosis or predisposition screening, analysis of the SNPs of the present invention can be combined with that of other polymorphisms or other risk factors of CHD, such as disease symptoms, pathological characteristics, family history, diet, environmental factors or lifestyle factors.

It will, of course, be understood by practitioners skilled in the treatment or diagnosis of CHD that the present invention generally does not intend to provide an absolute identification of individuals who are at risk (or less at risk) of developing CHD, and/or pathologies related to CHD, but rather to indicate a certain increased (or decreased) degree or likelihood of developing the disease based on statistically significant association results. However, this information is extremely valuable as it can be used to, for example, initiate preventive treatments or to allow an individual carrying one or more significant SNPs or SNP haplotypes to foresee warning signs such as minor clinical symptoms, or to have regularly scheduled physical exams to monitor for appearance of a condition in order to identify and begin treatment of the condition at an early stage. Particularly with diseases that are extremely debilitating or fatal if not treated on time, the knowledge of a potential predisposition, even if this predisposition is not absolute, would likely contribute in a very significant manner to treatment efficacy.

The diagnostic techniques of the present invention may employ a variety of methodologies to determine whether a test subject has a SNP or a SNP pattern associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in pathologies and disorders related to stenosis or MI.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Pharmacogenomics and Therapeutics/Drug Development

The present invention provides methods for assessing the pharmacogenomics of a subject harboring particular SNP alleles or haplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, *Nature* 405, 857-865 (2000); Gould Rothberg, *Nature Biotechnology* 19, 209-211 (2001); Eichelbaum, *Clin. Exp. Pharmacol. Physiol.* 23(10-11):983-985 (1996); and Linder, *Clin. Chem.* 43(2):254-266 (1997). The clinical outcomes of these variations can result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. For example, SNPs in drug metabolizing enzymes can affect the activity of these enzymes, which in turn can affect both the intensity and duration of drug action, as well as drug metabolism and clearance.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in treating stenosis or MI. Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et. al., *Trends in Biotechnology*, August 2000.). Thus, pharmacogenomics based on the SNPs disclosed herein has the potential to both save lives and reduce healthcare costs substantially.

Pharmacogenomics in general is discussed further in Rose et al., "Pharmacogenetic analysis of clinically relevant genetic polymorphisms", *Methods Mol Med.* 2003; 85:225-37. Pharmacogenomics as it relates to Alzheimer's disease and other neurodegenerative disorders is discussed in Cacabelos, "Pharmacogenomics for the treatment of dementia", *Ann Med.* 2002; 34(5):357-79, Maimone et al., "Pharmacogenomics of neurodegenerative diseases", *Eur J Pharmacol.* 2001 Feb. 9; 413(1):11-29, and Poirier, "Apolipoprotein E: a pharmacogenetic target for the treatment of Alzheimer's disease", *Mol Diagn.* 1999 December; 4(4):335-41. Pharmacogenomics as it relates to cardiovascular disorders is discussed in Siest et al., "Pharmacogenomics of drugs affecting the cardiovascular system", *Clin Chem Lab Med.* 2003 April; 41(4):590-9, Mukherjee et al., "Pharmacogenomics in cardiovascular diseases", *Prog Cardiovasc Dis.* 2002 May-June; 44(6):479-98, and Mooser et al., "Cardiovascular pharmacogenetics in the SNP era", *J Thromb Haemost.* 2003 July; 1(7):1398-402. Pharmacogenomics as it relates to cancer is discussed in McLeod et al., "Cancer pharmacogenomics: SNPs, chips, and the individual patient", *Cancer Invest.* 2003; 21(4):630-40 and Watters et al., "Cancer pharmacogenomics: current and future applications", *Biochim Biophys Acta.* 2003 Mar. 17; 1603(2):99-111.

The SNPs of the present invention also can be used to identify novel therapeutic targets for MI. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke (ed.), Marcel Dekker, Inc.: New York (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates (see, e.g., Thompson, *Drug Discovery Today*, 7 (17): 912-917 (2002)). Antisense oligonucleotides are directly useful as therapeutic agents, and are also useful for determining and validating gene function (e.g., in gene knock-out or knock-down experiments).

Antisense technology is further reviewed in: Lavery et al., "Antisense and RNAi: powerful tools in drug target discovery and validation", *Curr Opin Drug Discov Devel.* 2003 July; 6(4):561-9; Stephens et al., "Antisense oligonucleotide therapy in cancer", *Curr Opin Mol Ther.* 2003 April; 5(2): 118-22; Kurreck, "Antisense technologies. Improvement through novel chemical modifications", *Eur J. Biochem.* 2003 April; 270(8): 1628-44; Dias et al., "Antisense oligonucleotides: basic concepts and mechanisms", *Mol Cancer Ther.* 2002 March; 1(5):347-55; Chen, "Clinical development of antisense oligonucleotides as anti-cancer therapeutics", *Methods Mol Med.* 2003; 75:621-36; Wang et al., "Antisense anticancer oligonucleotide therapeutics", *Curr Cancer Drug Targets.* 2001 November; 1(3):177-96; and Bennett, "Efficiency of antisense oligonucleotide drug discovery", *Antisense Nucleic Acid Drug Dev.* 2002 June; 12(3):215-24.

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function):

Antisense molecules can be used to inactivate mRNA in order to inhibit gene expression and production of defective proteins. Accordingly, these molecules can be used to treat a disorder, such as stenosis or MI, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21, 22, or 23 nucleotides in length) known as small interfering RNAs (siRNAs) which the cell uses in a sequence-specific manner to recognize and destroy complementary RNAs (Thompson, *Drug Discovery Today*, 7 (17): 912-917 (2002)). Accordingly, an aspect of the present invention specifically contemplates isolated nucleic acid molecules that are about 18-26 nucleotides in length, preferably 19-25 nucleotides in length, and more preferably 20, 21, 22, or 23 nucleotides in length, and the use of these nucleic acid molecules for RNAi. Because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Reynolds et al., "Rational siRNA design for RNA interference", *Nat Biotechnol.* 2004 March; 22(3):326-30. Epub 2004 Feb. 1; Chi et al., "Genomewide view of gene silencing by small interfering RNAs", *PNAS* 100(11):6343-6346, 2003; Vickers et al., "Efficient Reduction of Target RNAs by Small Interfering RNA and RNase H-dependent Antisense Agents", *J. Biol. Chem.* 278: 7108-7118, 2003; Agami, "RNAi and related mechanisms and their potential use for therapy", *Curr Opin Chem Biol.* 2002 December; 6(6):829-34; Lavery et al., "Antisense and RNAi: powerful tools in drug target discovery and validation", *Curr Opin Drug Discov Devel.* 2003 July; 6(4):561-9; Shi, "Mammalian RNAi for the masses", *Trends Genet* 2003 January; 19(1):9-12), Shuey et al., "RNAi: gene-silencing in therapeutic intervention", *Drug Discovery Today* 2002 October; 7(20): 1040-1046; McManus et al., *Nat Rev Genet* 2002 October; 3(10): 737-47; Xia et al., *Nat Biotechnol* 2002 October; 20(10): 1006-10; Plasterk et al., *Curr Opin Genet Dev* 2000 October; 10(5):562-7; Bosher et al., *Nat Cell Biol* 2000 February; 2(2):E31-6; and Hunter, *Curr Biol* 1999 Jun. 17; 9(12):R440-2).

A subject suffering from a pathological condition, such as stenosis or MI, ascribed to a SNP may be treated so as to correct the genetic defect (see Kren et al., *Proc. Natl. Acad. Sci. USA* 96:10349-10354 (1999)). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

The invention further provides a method for identifying a compound or agent that can be used to treat stenosis or MI. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a stenosis or MI patient can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment, the regulatory regions of these genes can be operably linked to a reporter gene such as luciferase.

Modulators of variant gene expression can be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as stenosis or MI that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

The SNP-containing nucleic acid molecules of the present invention are also useful for monitoring the effectiveness of modulating compounds on the expression or activity of a variant gene, or encoded product, in clinical trials or in a treatment regimen. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

In another aspect of the present invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to humans diagnostically tested for one or more SNPs or SNP haplotypes provided by the present invention.

The SNPs/haplotypes of the present invention are also useful for improving many different aspects of the drug development process. For instance, an aspect of the present invention includes selecting individuals for clinical trials based on their SNP genotype. For example, individuals with SNP genotypes that indicate that they are likely to positively respond to a drug can be included in the trials, whereas those individuals whose SNP genotypes indicate that they are less likely to or would not respond to the drug, or who are at risk for suffering toxic effects or other adverse reactions, can be excluded from the clinical trials. This not only can improve the safety of clinical trials, but also can enhance the chances that the trial will demonstrate statistically significant efficacy. Furthermore, the SNPs of the present invention may explain why certain previously developed drugs performed poorly in clinical trials and may help identify a subset of the population that would benefit from a drug that had previously performed poorly in clinical trials, thereby "rescuing" previously developed drugs, and enabling the drug to be made available to a particular stenosis or MI patient population that can benefit from it.

SNPs have many important uses in drug discovery, screening, and development. A high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. (Jazwinska, *A Trends Guide to Genetic Variation and Genomic Medicine*, 2002 March; S30-S36).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants (Rothberg, *Nat Biotechnol* 2001 March; 19(3):209-11). Such therapeutic candidates Would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population (Jazwinska, *A Trends Guide to Genetic Variation and Genomic Medicine*, 2002 March; S30-S36).

Additionally, screening therapeutic candidates against all known variants of a target can enable the early identification of potential toxicities and adverse reactions relating to particular variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1-2, are useful in conjunction with a variety of toxicology methods established in the art, such as those set forth in *Current Protocols in Toxicology*, John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1-2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

Pharmaceutical Compositions and Administration Thereof

Any of the MI-associated proteins, and encoding nucleic acid molecules, disclosed herein can be used as therapeutic targets (or directly used themselves as therapeutic compounds) for treating stenosis or MI and related pathologies, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities. The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70 kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 nm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipients may be any solid, liquid, semi-solid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in Remington's Pharmaceutical Sciences, edited by E. W. Martin (Mack Publishing Company, 18$^{th}$ ed., 1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80 wt %.

Therapeutic compounds can be administered alone or in combination with other therapeutic compounds or in combination with one or more other active ingredient(s). For example, an inhibitor or stimulator of an stenosis or MI-associated protein can be administered in combination with another agent that inhibits or stimulates the activity of the same or a different MI-associated protein to thereby counteract the affects of stenosis or MI.

For further information regarding pharmacology, see *Current Protocols in Pharmacology*, John Wiley & Sons, Inc., N.Y.

Human Identification Applications

In addition to their diagnostic and therapeutic uses in stenosis or MI and related pathologies, the SNPs provided by the present invention are also useful as human identification markers for such applications as forensics, paternity testing, and biometrics (see, e.g., Gill, "An assessment of the utility of single nucleotide polymorphisms (SNPs) for forensic purposes", *Int J Legal Med.* 2001; 114(4-5):204-10). Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked (i.e., inherited independently). Thus, preferred sets of SNPs can be selected from among the SNPs disclosed herein, which may include SNPs on different chromosomes, SNPs on different chromosome arms, and/or SNPs that are dispersed over substantial distances along the same chromosome arm.

Furthermore, among the SNPs disclosed herein, preferred SNPs for use in certain forensic/human identification applications include SNPs located at degenerate codon positions (i.e., the third position in certain codons which can be one of two or more alternative nucleotides and still encode the same amino acid), since these SNPs do not affect the encoded protein. SNPs that do not affect the encoded protein are expected to be under less selective pressure and are therefore expected to be more polymorphic in a population, which is typically an advantage for forensic/human identification applications. However, for certain forensics/human identification applications, such as predicting phenotypic characteristics (e.g., inferring ancestry or inferring one or more physical characteristics of an individual) from a DNA sample, it may be desirable to utilize SNPs that affect the encoded protein.

For many of the SNPs disclosed in Tables 1-2 (which are identified as "Applera" SNP source), Tables 1-2 provide SNP allele frequencies obtained by re-sequencing the DNA of chromosomes from 39 individuals (Tables 1-2 also provide allele frequency information for "Celera" source SNPs and, where available, public SNPs from dbEST, HGBASE, and/or HGMD). The allele frequencies provided in Tables 1-2 enable these SNPs to be readily used for human identification applications. Although any SNP disclosed in Table 1 and/or Table 2 could be used for human identification, the closer that the frequency of the minor allele at a particular SNP site is to 50%, the greater the ability of that SNP to discriminate between different individuals in a population since it becomes increasingly likely that two randomly selected individuals would have different alleles at that SNP site. Using the SNP allele frequencies provided in Tables 1-2, one of ordinary skill in the art could readily select a subset of SNPs for which the frequency of the minor allele is, for example, at least 1%, 2%, 5%, 10%, 20%, 25%, 30%, 40%, 45%, or 50%, or any other frequency in-between. Thus, since Tables 1-2 provide allele frequencies based on the re-sequencing of the chromosomes from 39 individuals, a subset of SNPs could readily be selected for human identification in which the total allele count of the minor allele at a particular SNP site is, for example, at least 1, 2, 4, 8, 10, 16, 20, 24, 30, 32, 36, 38, 39, 40, or any other number in-between.

Furthermore, Tables 1-2 also provide population group (interchangeably referred to herein as ethnic or racial groups) information coupled with the extensive allele frequency information. For example, the group of 39 individuals whose DNA was re-sequenced was made-up of 20 Caucasians and 19 African-Americans. This population group information enables further refinement of SNP selection for human identification. For example, preferred SNPs for human identification can be selected from Tables 1-2 that have similar allele frequencies in both the Caucasian and African-American populations; thus, for example, SNPs can be selected that have equally high discriminatory power in both populations. Alternatively, SNPs can be selected for which there is a statistically significant difference in allele frequencies between the Caucasian and African-American populations (as an extreme example, a particular allele may be observed only in either the Caucasian or the African-American population group but not observed in the other population group); such SNPs are useful, for example, for predicting the race/ethnicity of an unknown perpetrator from a biological sample such as a hair or blood stain recovered at a crime scene. For a discussion of using SNPs to predict ancestry from a DNA sample, including statistical methods, see Frudakis et al., "A Classifier for the SNP-Based Inference of Ancestry," *Journal of Forensic Sciences* 2003; 48(4):771-782.

SNPs have numerous advantages over other types of polymorphic markers, such as short tandem repeats (STRs). For example, SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationaly more stable than repeat polymorphisms. SNPs are not susceptible to artefacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. A SNP, on the other hand, comprises a single nucleotide, and generally a short conserved region on either side of the SNP position for primer and/or probe binding. This makes SNPs more amenable to typing in highly degraded or aged biological samples that are frequently encountered in forensic casework in which DNA may be fragmented into short pieces.

SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units than has been previously seen in the population, or more or less repeat alleles than are included in a reference allelic ladder. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis.

SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, and therefore the statistical significance of a matching genotype may be questionable. All these advantages of SNP analysis are considerable in light of the consequences of most DNA identification cases, which may lead to life imprisonment for an individual, or re-association of remains to the family of a deceased individual.

DNA can be isolated from biological samples such as blood, bone, hair, saliva, or semen, and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs known in the art or STRs, in order to identify an individual or to associate an individual with a particular biological sample.

Furthermore, the SNPs provided by the present invention can be genotyped for inclusion in a database of DNA genotypes, for example, a criminal DNA databank such as the FBI's Combined DNA Index System (CODIS) database. A genotype obtained from a biological sample of unknown source can then be queried against the database to find a matching genotype, with the SNPs of the present invention providing nucleotide positions at which to compare the known and unknown DNA sequences for identity. Accordingly, the present invention provides a database comprising novel SNPs or SNP alleles of the present invention (e.g., the database can comprise information indicating which alleles are possessed by individual members of a population at one or more novel SNP sites of the present invention), such as for use in forensics, biometrics, or other human identification applications. Such a database typically comprises a computer-based system in which the SNPs or SNP alleles of the present invention are recorded on a computer readable medium (see the section of the present specification entitled "Computer-Related Embodiments").

The SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child, with the SNPs of the present invention providing nucleotide positions at which to compare the putative father's and child's DNA sequences for identity. If the set of polymorphisms in the child attributable to the father does not match the set of polymorphisms of the putative father, it can be concluded, barring experimental error, that the putative father is not the father of the child. If the set of polymorphisms in the child attributable to the father match the set of polymorphisms of the putative father, a statistical calculation can be performed to determine the probability of coincidental match, and a conclusion drawn as to the likelihood that the putative father is the true biological father of the child.

In addition to paternity testing, SNPs are also useful for other types of kinship testing, such as for verifying familial relationships for immigration purposes, or for cases in which an individual alleges to be related to a deceased individual in order to claim an inheritance from the deceased individual, etc. For further information regarding the utility of SNPs for paternity testing and other types of kinship testing, including methods for statistical analysis, see Krawczak, "Informativity assessment for biallelic single nucleotide polymorphisms", *Electrophoresis* 1999 June; 20(8):1676-81.

The use of the SNPs of the present invention for human identification further extends to various authentication systems, commonly referred to as biometric systems, which typically convert physical characteristics of humans (or other organisms) into digital data. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and, for example, restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns (see, for example, O'Connor, *Stanford Technology Law Review* and U.S. Pat. No. 6,119,096).

Groups of SNPs, particularly the SNPs provided by the present invention, can be typed to uniquely identify an individual for biometric applications such as those described above. Such SNP typing can readily be accomplished using, for example, DNA chips/arrays. Preferably, a minimally invasive means for obtaining a DNA sample is utilized. For example, PCR amplification enables sufficient quantities of DNA for analysis to be obtained from buccal swabs or fingerprints, which contain DNA-containing skin cells and oils that are naturally transferred during contact.

Further information regarding techniques for using SNPs in forensic/human identification applications can be found in, for example, *Current Protocols in Human Genetics*, John Wiley & Sons, N.Y. (2002), 14.1-14.7.

Variant Proteins, Antibodies, Vectors, Host Cells, & Uses Thereof

Variant Proteins Encoded by SNP-Containing Nucleic Acid Molecules

The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are referred to as SEQ ID NOS: 68-134 in Table 1 and provided in the Sequence Listing. These variants will generally be referred to herein as variant proteins/peptides/polypeptides, or polymorphic proteins/peptides/polypeptides of the present invention. The terms "protein," "peptide," and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below (Sambrook and Russell, 2000, Molecular Cloning: A Laboratory Manual, Cold Spring Harbor Laboratory Press, Cold Spring Harbor, N.Y.).

The present invention provides isolated variant proteins that comprise, consist of or consist essentially of amino acid sequences that contain one or more variant amino acids encoded by one or more codons that contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., *Current Protocols in Molecular Biology*, 1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e.g., mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems", *Appl Microbiol Biotechnol.* 2003 January; 60(5):523-33. Epub 2002 Nov. 7; Graddis et al., "Designing proteins that work using recombinant technologies", *Curr Pharm Biotechnol.* 2002 December; 3(4):285-97; and Nilsson et al., "Affinity fusion strategies for detection, purification, and immobilization of recombinant proteins", *Protein Expr Purif.* 1997 October; 11(1): 1-16.

The present invention also relates to further obvious variants of the variant polypeptides of the present invention, such as naturally-occurring mature forms (e.g., alleleic variants), non-naturally occurring recombinantly-derived variants, and orthologs and paralogs of such proteins that share sequence homology. Such variants can readily be generated using art-known techniques in the fields of recombinant nucleic acid technology and protein biochemistry. It is understood, however, that variants exclude those known in the prior art before the present invention.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in, for example, Bowie et al., *Science* 247:1306-1310 (1990).

Variant proteins can be fully functional or can lack function in one or more activities, e.g. ability to bind another molecule, ability to catalyze a substrate, ability to mediate signaling, etc. Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis (Cunningham et al., *Science* 244:1081-1085 (1989)), particularly using the amino acid sequence and polymorphism information provided in Table 1. The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling (Smith et al., *J. Mol. Biol.* 224:899-904 (1992); de Vos et al. *Science* 255:306-312 (1992)).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as *Proteins—Structure and Molecular Properties,* 2nd Ed., T. E. Creighton, W. H. Freeman and Company, New York (1993); Wold, F., *Posttranslational Covalent Modification of Proteins,* B. C. Johnson, Ed., Academic Press, New York 1-12 (1983); Seifter et al., *Meth. Enzymol.* 182: 626-646 (1990); and Rattan et al., *Ann. N.Y. Acad. Sci.* 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis) (*Current Protocols in Protein Science*, John Wiley & Sons, N.Y. (2002)).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art (see, e.g., Molecular Cloning: A Laboratory Manual, Cold Spring Harbor Laboratory Press, Sambrook and Russell, 2000, and Methods in Enzymology: Guide to Molecular Cloning Techniques, Academic Press, Berger, S. L. and A. R. Kimmel eds., 1987).

In a specific embodiment of the invention, the methods of the present invention include detection of one or more variant proteins disclosed herein. Variant proteins are disclosed in Table 1 and in the Sequence Listing as SEQ ID NOS: 68-134. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another specific aspect of the invention, the variant proteins of the present invention are used as targets for diagnosing stenosis or MI or for determining predisposition to stenosis or MI in a human. Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips").

The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with MI that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays", *Anal Chem.* 1999 Jun. 15; 71(12):294R-304R.

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or norepinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., Nature 354:82-84 (1991); Houghten et al., Nature 354:84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., Cell 72:767-778 (1993)); 3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an end-point assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein (Hodgson, Bio/technology, 1992, Sep. 10(9), 973-80).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S-transferase/$^{125}$I fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin.

Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as MI. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay (see, e.g., U.S. Pat. No. 5,283,317; Zervos et al. (1993) Cell 72:223-232; Madura et al. (1993) J. Biol. Chem. 268:12046-12054; Bartel et al. (1993) Biotechniques 14:920-924; Iwabuchi et al. (1993) Oncogene 8:1693-1696; and Brent WO94/10300) to identify other proteins that bind to or interact with the variant protein and are involved in variant protein activity. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein.

The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the functional transcription factor can be isolated and used to obtain the cloned gene that encodes the protein that interacts with the variant protein.

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)$'_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., Proc. Natl. Acad. Sci. USA, 81:6851, 1984; Neuberger et al., Nature 312:604, 1984), a humanized antibody (U.S. Pat. Nos. 5,693,762; 5,585,089; and 5,565,332), a single-chain Fv (U.S. Pat. No. 4,946,778; Ward et al., Nature 334:544, 1989), a bispecific antibody with two binding specificities (Segal et al., J. Immunol Methods 248:1, 2001; Carter, J. Immunol. Methods 248:7, 2001), a diabody, a triabody, and a tetrabody (Todorovska et al., J. Immunol. Methods, 248:47, 2001), as well as a Fab conjugate (dimer or trimer), and a minibody.

Many methods are known in the art for generating and/or identifying antibodies to a given target antigen (Harlow, Antibodies, Cold Spring Harbor Press, (1989)). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology (Kohler and Milstein, Nature, 256:495, 1975), which immortalizes cells secreting a specific monoclonal antibody. The immortalized cell lines can be created in vitro by fusing two different cell types, typically lymphocytes, and tumor cells. The hybridoma cells may be cultivated in vitro or in vivo. Additionally, fully human antibodies can be generated by transgenic animals (He et al., J. Immunol., 169:595, 2002). Fd phage and Fd phagemid technologies may be used to generate and select recombinant antibodies in vitro (Hoogenboom and Chames, Immunol. Today 21:371, 2000; Liu et al., J. Mol. Biol. 315:1063, 2002). The complementarity-determining regions of an antibody can be identified, and synthetic peptides corresponding to such regions may be used to mediate antigen binding (U.S. Pat. No. 5,637,677).

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

Antibodies, particularly the use of antibodies as therapeutic agents, are reviewed in: Morgan, "Antibody therapy for Alzheimer's disease," *Expert Rev Vaccines.* 2003 February; 2(1):53-9; Ross et al., "Anticancer antibodies," *Am J Clin Pathol.* 2003 April; 119(4):472-85; Goldenberg, "Advancing role of radiolabeled antibodies in the therapy of cancer," *Cancer Immunol Immunother.* 2003 May; 52(5):281-96. Epub 2003 Mar. 11; Ross et al., "Antibody-based therapeutics in oncology," *Expert Rev Anticancer Ther.* 2003 February; 3(1):107-21; Cao et al., "Bispecific antibody conjugates in therapeutics," *Adv Drug Deliv Rev.* 2003 Feb. 10; 55(2):171-97; von Mehren et al., "Monoclonal antibody therapy for cancer," *Annu Rev Med.* 2003; 54:343-69. Epub 2001 Dec. 3; Hudson et al., "Engineered antibodies," *Nat Med.* 2003 January; 9(1):129-34; Brekke et al., "Therapeutic antibodies for human diseases at the dawn of the twenty-first century," *Nat Rev Drug Discov.* 2003 January; 2(1):52-62 (Erratum in: *Nat Rev Drug Discov.* 2003 March; 2(3):240); Houdebine, "Antibody manufacture in transgenic animals and comparisons with other systems," *Curr Opin Biotechnol.* 2002 December; 113(6):625-9; Andreakos et al., "Monoclonal antibodies in immune and inflammatory diseases," *Curr Opin Biotechnol.* 2002 December; 13(6):615-20; Kellermann et al., "Antibody discovery: the use of transgenic mice to generate human monoclonal antibodies for therapeutics," *Curr Opin Biotechnol.* 2002 December; 13(6):593-7; Pini et al., "Phage display and colony filter screening for high-throughput selection of antibody libraries," *Comb Chem High Throughput Screen.* 2002 November; 5(7):503-10; Batra et al., "Pharmacokinetics and biodistribution of genetically engineered antibodies," *Curr Opin Biotechnol.* 2002 December; 13(6):603-8; and Tangri et al., "Rationally engineered proteins or antibodies with absent or reduced immunogenicity," *Curr Med. Chem.* 2002 December; 9(24):2191-9.

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as MI. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, particularly stenosis or MI. Antibodies specific for a variant protein encoded by a SNP-containing nucleic acid molecule of the present invention can be used to assay for the presence of the variant protein, such as to screen for predisposition to MI as indicated by the presence of the variant protein.

Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol (Leong et al., *Cytokine* 16:106, 2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors (see, e.g., Sambrook and Russell, 2000, Molecular Cloning: A Laboratory Manual, Cold Spring Harbor Laboratory Press, Cold Spring Harbor, N.Y.).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, 2000, Molecular Cloning: A Laboratory Manual, Cold Spring Harbor Laboratory Press, Cold Spring Harbor, N.Y.

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *E. coli, Streptomyces*, and *Salmonella typhimurium*. Eukaryotic host cells include, but are not limited to, yeast, insect cells such as *Drosophila*, animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301-315 (1988))

and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (Gottesman, S., *Gene Expression Technology: Methods in Enzymology* 185, Academic Press, San Diego, Calif. (1990) 119-128). Alternatively, the sequence of the SNP-containing nucleic acid molecule of interest can be altered to provide preferential codon usage for a specific host cell, for example, *E. coli* (Wada et al., *Nucleic Acids Res.* 20:2111-2118 (1992)).

The SNP-containing nucleic acid molecules can also be expressed by expression vectors that are operative in yeast. Examples of vectors for expression in yeast (e.g., *S. cerevisiae*) include pYepSec1 (Baldari, et al., *EMBO J.* 6:229-234 (1987)), pMFa (Kujan et al., *Cell* 30:933-943(1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol. Cell Biol.* 3:2156-2165 (1983)) and the pVL series (Lucklow et al., *Virology* 170:31-39 (1989)).

In certain embodiments of the invention, the SNP-containing nucleic acid molecules described herein are expressed in mammalian cells using mammalian expression vectors. Examples of mammalian expression vectors include pCDM8 (Seed, B. *Nature* 329:840(1987)) and pMT2PC (Kaufman et al., *EMBO J.* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, 2000, Molecular Cloning: A Laboratory Manual, Cold Spring Harbor Laboratory, Cold Spring Harbor Laboratory Press, Cold Spring Harbor, N.Y.).

Host cells can contain more than one vector. Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see *Current Protocols in Molecular Biology*, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein in particular cells or tissues.

Methods for generating transgenic animals via embryo manipulation and microinjection, particularly animals such as mice, have become conventional in the art and are described in, for example, U.S. Pat. Nos. 4,736,866 and 4,870,009, both by Leder et al., U.S. Pat. No. 4,873,191 by Wagner et al., and in Hogan, B., *Manipulating the Mouse Embryo*, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1 (Lakso et al. *PNAS* 89:6232-6236 (1992)). Another example of a recombinase system is the FLP recombinase system of *S. cerevisiae* (O'Gorman et al. *Science* 251: 1351-1355 (1991)). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described in, for example, Wilmut, I. et al. *Nature* 385:810-813 (1997) and PCT International Publication Nos. WO 97/07668 and WO 97/07669. In brief, a cell (e.g., a somatic cell) from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context. Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems," *Curr Opin Biotechnol.* 2002 December; 13(6):625-9; Petters et al., "Transgenic animals as models for human disease," *Transgenic Res.* 2000; 9(4-5):347-51; discussion 345-6; Wolf et al., "Use of transgenic animals in understanding molecular mechanisms of toxicity," *J Pharm Pharmacol.* 1998 June; 50(6):567-74; Echelard, "Recombinant protein production in transgenic animals," *Curr Opin Biotechnol.* 1996 October; 7(5):536-40; Houdebine, "Transgenic animal bioreactors," *Transgenic Res.* 2000; 9(4-5):305-20; Pirity et al., "Embryonic stem cells, creating transgenic animals," *Methods Cell Biol.* 1998; 57:279-93; and Robl et al., "Artificial chromosome vectors and expression of complex proteins in transgenic animals," *Theriogenology.* 2003 Jan. 1; 59(1):107-13.

Computer-Related Embodiments

The SNPs provided in the present invention may be "provided" in a variety of mediums to facilitate use thereof. As used in this section, "provided" refers to a manufacture, other than an isolated nucleic acid molecule, that contains SNP information of the present invention. Such a manufacture provides the SNP information in a form that allows a skilled artisan to examine the manufacture using means not directly applicable to examining the SNPs or a subset thereof as they exist in nature or in purified form. The SNP information that may be provided in such a form includes any of the SNP information provided by the present invention such as, for example, polymorphic nucleic acid and/or amino acid sequence information such as SEQ ID NOS: 1-67, SEQ ID NOS: 68-134, SEQ ID NOS: 229-299, SEQ ID NOS: 135-228, and SEQ ID NOS: 300-504; information about observed SNP alleles, alternative codons, populations, allele frequencies, SNP types, and/or affected proteins; or any other information provided by the present invention in Tables 1-2 and/or the Sequence Listing.

In one application of this embodiment, the SNPs of the present invention can be recorded on a computer readable medium. As used herein, "computer readable medium" refers to any medium that can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable media can be used to create a manufacture comprising computer readable medium having recorded thereon a nucleotide sequence of the present invention. One such medium is provided with the present application, namely, the present application contains computer readable medium (CD-R) that has nucleic acid sequences (and encoded protein sequences) containing SNPs provided/recorded thereon in ASCII text format in a Sequence Listing along with accompanying Tables that contain detailed SNP and related sequence information (transcript sequences are referred to as SEQ ID NOS: 1-67, protein sequences are provided as SEQ ID NOS: 68-134, genomic sequences are provided as SEQ ID NOS: 229-299, transcript-based context sequences are provided as SEQ ID NOS: 135-228, and genomic-based context sequences are provided as SEQ ID NOS: 300-504).

As used herein, "recorded" refers to a process for storing information on computer readable medium. A skilled artisan can readily adopt any of the presently known methods for recording information on computer readable medium to generate manufactures comprising the SNP information of the present invention.

A variety of data storage structures are available to a skilled artisan for creating a computer readable medium having recorded thereon a nucleotide or amino acid sequence of the present invention. The choice of the data storage structure will generally be based on the means chosen to access the stored information. In addition, a variety of data processor programs and formats can be used to store the nucleotide/amino acid sequence information of the present invention on computer readable medium. For example, the sequence information can be represented in a word processing text file, formatted in commercially-available software such as WordPerfect and Microsoft Word, represented in the form of an ASCII file, or stored in a database application, such as OB2, Sybase, Oracle, or the like. A skilled artisan can readily adapt any number of data processor structuring formats (e.g., text file or database) in order to obtain computer readable medium having recorded thereon the SNP information of the present invention.

By providing the SNPs of the present invention in computer readable form, a skilled artisan can routinely access the SNP information for a variety of purposes. Computer software is publicly available which allows a skilled artisan to access sequence information provided in a computer readable medium. Examples of publicly available computer software include BLAST (Altschul et al., *J. Mol. Biol.* 215:403-410 (1990)) and BLAZE (Brutlag et al., *Comp. Chem.* 17:203-207 (1993)) search algorithms.

The present invention further provides systems, particularly computer-based systems, which contain the SNP information described herein. Such systems may be designed to store and/or analyze information on, for example, a large number of SNP positions, or information on SNP genotypes from a large number of individuals. The SNP information of the present invention represents a valuable information source. The SNP information of the present invention stored/analyzed in a computer-based system may be used for such computer-intensive applications as determining or analyzing SNP allele frequencies in a population, mapping disease genes, genotype-phenotype association studies, grouping SNPs into haplotypes, correlating SNP haplotypes with response to particular drugs, or for various other bioinformatic, pharmacogenomic, drug development, or human identification/forensic applications.

As used herein, "a computer-based system" refers to the hardware means, software means, and data storage means used to analyze the SNP information of the present invention. The minimum hardware means of the computer-based systems of the present invention typically comprises a central processing unit (CPU), input means, output means, and data storage means. A skilled artisan can readily appreciate that any one of the currently available computer-based systems are suitable for use in the present invention. Such a system can be changed into a system of the present invention by utilizing the SNP information provided on the CD-R, or a subset thereof, without any experimentation.

As stated above, the computer-based systems of the present invention comprise a data storage means having stored therein SNPs of the present invention and the necessary hardware means and software means for supporting and implementing a search means. As used herein, "data storage means" refers to memory which can store SNP information of the present invention, or a memory access means which can access manufactures having recorded thereon the SNP information of the present invention.

As used herein, "search means" refers to one or more programs or algorithms that are implemented on the computer-based system to identify or analyze SNPs in a target sequence based on the SNP information stored within the data storage means. Search means can be used to determine which nucleotide is present at a particular SNP position in the target sequence. As used herein, a "target sequence" can be any DNA sequence containing the SNP position(s) to be searched or queried.

As used herein, "a target structural motif," or "target motif," refers to any rationally selected sequence or combination of sequences containing a SNP position in which the sequence(s) is chosen based on a three-dimensional configuration that is formed upon the folding of the target motif. There are a variety of target motifs known in the art. Protein target motifs include, but are not limited to, enzymatic active sites and signal sequences. Nucleic acid target motifs include, but are not limited to, promoter sequences, hairpin structures, and inducible expression elements (protein binding sequences).

A variety of structural formats for the input and output means can be used to input and output the information in the computer-based systems of the present invention. An exemplary format for an output means is a display that depicts the presence or absence of specified nucleotides (alleles) at particular SNP positions of interest. Such presentation can provide a rapid, binary scoring system for many SNPs simultaneously.

One exemplary embodiment of a computer-based system comprising SNP information of the present invention is provided in FIG. 1. FIG. 1 provides a block diagram of a computer system 102 that can be used to implement the present invention. The computer system 102 includes a processor 106 connected to a bus 104. Also connected to the bus 104 are a main memory 108 (preferably implemented as random access memory, RAM) and a variety of secondary storage devices 110, such as a hard drive 112 and a removable medium storage device 114. The removable medium storage device 114 may represent, for example, a floppy disk drive, a CD-ROM drive, a magnetic tape drive, etc. A removable storage medium 116 (such as a floppy disk, a compact disk, a magnetic tape, etc.) containing control logic and/or data recorded therein may be inserted into the removable medium storage device 114. The computer system 102 includes appropriate software for reading the control logic and/or the data from the removable storage medium 116 once inserted in the removable medium storage device 114.

The SNP information of the present invention may be stored in a well-known manner in the main memory 108, any of the secondary storage devices 110, and/or a removable storage medium 116. Software for accessing and processing the SNP information (such as SNP scoring tools, search tools, comparing tools, etc.) preferably resides in main memory 108 during execution.

EXAMPLES

The following examples are offered to illustrate, but not to limit, the claimed invention.

Example 1

Statistical Analysis of SNP Allelic and Genotypic Association with MI Risk

A case-control genetic study was performed to determine the association of SNPs in the human genome with coronary heart disease (CHD), and in particular myocardial infarction (MI), using genomic DNA extracted from two independently obtained sample sets. One set was obtained from the University of California at San Francisco (UCSF). Only individuals self-described as Caucasian were used, in order to minimize the likelihood of population stratification. Individuals included patients who had undergone diagnostic or interventional cardiac catheterization, patients at the UCSF Lipid Clinic, and healthy older individuals. The samples were divided into cases and controls based on study design (Table 4). Cases were individuals with a history of MI, and controls were individuals with no symptomatic cardiovascular disease (CVD). CVD in this study refers to such conditions as unstable angina, coronary aneurysm, CHD such as MI, etc. MI was defined as a medical diagnosis of ICD9 code 410 or 411 (World Heath Organization's *International Classification of Disease, 9th Revision*), by a clinical chart review or self-reported history. Efforts by UCSF physicians to clinically verify self-reported MI have resulted in better than 98% verification. For each particular SNP association study, a subset of the case and control populations were investigated (see Table 4, Design Key). All individuals had signed an informed consent form. The protocols for obtaining patient samples were approved by the Institutional Review Board (IRB).

A second sample set was obtained from the Cleveland Clinic Foundation Heart Center (CCF), from individuals who had undergone diagnostic or interventional cardiac catheterization. This set consisted of DNA from Caucasian individuals who had had no coronary artery stenosis, or stenosis varying in degree from low to severe as evidenced by coronary angiography. A subset of individuals also had a history of MI. Samples were divided into cases and controls: cases were individuals with a history of MI, while controls had no MI and varying levels of stenosis. For each particular SNP association study, a subset of the case and control populations were investigated (see Table 4, Design Key). "Low stenosis" was considered less than 50% stenosis by angiography. Individuals were between the ages of 18-75 and had signed an informed consent form. The protocols for obtaining patient samples were approved by the IRB.

DNA was extracted from blood samples at CCF or UCSF using conventional DNA extraction methods or commercially available kits, such as the QIA-amp kit from Qiagen (Valencia, Calif.), according to the manufacturer's suggestions. SNP markers in the extracted DNA were analyzed by genotyping. Initially, pooling studies were performed in which DNA samples from about 50 individuals from each sample set were pooled and the allele frequencies for specific markers were obtained using a PRISM® 7900HT Sequence Detection System (Applied Biosystems, Foster City, Calif.) by allele-specific PCR, similar to the method described by Germer et al. *Genome Research* 10:258-266 (2000). (PCR primers used in this example and Example 2, following, are shown in Table 3 with their corresponding SNP markers by hCV.) Those SNPs with an observed P value<0.1 (Fisher Exact test) for association with MI in the pooled samples were selected as candidates for validation by individual genotyping.

For validation of SNP association with MI based on the results of the pooling studies, samples from CCF and UCSF were individually genotyped by performing oligonucleotide ligation assays (OLA). Briefly, in OLA the genomic regions containing the SNPs of interest were amplified from sample DNA using upper and lower PCR primers. The resultant amplicons were then mixed in a hybridization reaction with the two allele-specific oligonucleotides (ASO1 and ASO2) and one common ligation-specific oligonucleotide (LSO) for each marker. Each allele-specific oligonucleotide was attached to a Luminex® bead that had a specific fluorescence. One of the two allele-specific oligonucleotides hybridized with each amplicon, and was then ligated to the LSO by the ligase in the reaction mixture. The samples' genotypes were determined when the ligated products were then detected in a Luminex®100™ fluorimeter (Luminex Corporation, Austin, Tex.).

Genotype or allele frequencies of SNPs in the UCSF and CCF samples were analyzed for association with MI as a clinical endpoint. Results of this analysis are reported in Table 4, for 44 SNPs showing association with CHD, specifically based on their association with MI. Allele or genotype frequencies for the tested SNPs were compared between cases and controls to determine MI risk association, according to the various case/control designs (Table 4). The magnitude of the allelic or genotypic effect on risk association (effect size) was estimated by an odds ratio (OR). An allele or genotype may be under- or overrepresented in cases. An allele or genotype overrepresented in cases indicates that the reported allele or genotype is a risk factor for disease. An allele or genotype underrepresented in cases indicates that this allele/genotype is protective against disease. A SNP was considered a marker for MI risk if the association analyses in the two sample sets (CCF and UCSF) showed the same risk allele, and P values less than or equal to 0.1 in both sets. Allelic P values were calculated using the Fisher Exact test; genotypic (i.e. dominant/recessive) P values were calculated using the asymptotic chi-square test. No multiple testing corrections were made. Where the allele frequencies of cases vs. controls indicated an MI risk association in a particular population stratification, this is indicated in the "Stratum" columns of Table 4. For example, hCV1283127 was observed to be associated with MI when allele frequencies in male MI cases were compared with male non-MI controls. Other population stratifications where a particular SNP was found to be associated with MI were age, body mass index (BMI), hypertension, sex, and smoking status (smokers and non-smokers).

One example of a SNP marker where the genotype containing two copies of the risk allele is associated with an increased risk for MI (i.e. homzygous recessive) is hCV 16189747, a marker in the SNX19 gene (Table 4). Samples from CCF and UCSF were individually genotyped for hCV16189747 (Table 4). In the CCF sample set, 446 cases and 577 controls were genotyped. Cases all had a history of MI, while controls had no MI and low (<50%) or no stenosis by angiography. In the UCSF sample set, 740 cases and 951 controls were genotyped. Cases had a history of MI while controls had no symptomatic CVD. Individuals with two copies of the C allele at this SNP position, i.e. inheritance mode recessive (Rec), in both CCF and UCSF sets showed a significant association with increased risk of MI (P values of 0.093 and 0.056, OR of 1.24 and 1.21, respectively) when compared to those carrying one or no copies of the risk allele (heterozygous and homozygous for the non-risk allele), in case and control populations unstratified by phenotype (Stratum "All").

This and all other SNP markers described herein may also be found in Tables 1 and 2. In Table 1, context sequence information is provided regarding the transcript in which each SNP is found, if it resides in a transcript. For example this SNP marker, Celera SNP ID hCV 16189747, is found in the transcript sequence of SEQ ID 217 (Table 1). Also provided in Table 1 is other information regarding the transcript in which the SNP is located: the gene symbol, SNX19; position of the SNP in the transcript; chromosome, 11; the Public SNP ID (i.e. the rs, or RefSNP, number from the National Center for Biotechnology Information SNP database if known), rs2298566; SNP type, Missense Mutation, etc. In Table 2 is provided genomic sequence information for all SNP markers described herein. For example Celera SNP ID hCV16189747 is found in the genomic sequence of SEQ ID 259 (Table 2). In the event that there are SNPs calculated to be in LD with the interrogated SNP, that information is also provided in Tables 1 and 2, as a "Related Interrogated SNP." E.g., see SEQ ID 393 in Table 2, where the Celera SNP ID for the interrogated SNP is hCV3108698, and the related LD SNP directly following is hCV15954965 (power of 0.8).

Another example of a SNP marker where the genotype containing two copies of the risk allele (homozygous) is associated with an increased risk for MI is hCV7425232, a marker in the MYH15 gene. Samples from CCF and UCSF were individually genotyped for this SNP (Table 4). In the CCF sample set, genotyping results were obtained from 170 female cases and 226 female controls. Cases had a history of MI, while controls had no MI and low (<50%) or no stenosis. In the UCSF sample set, genotyping results from 300 female cases and 553 female controls were obtained. Cases had a history of MI, while controls had no symptomatic CVD. An analysis of the allele frequencies obtained from the female cases vs. female controls showed an association of this SNP with MI in the female population stratification (Stratum "FM"). Females with two copies of the C allele at this SNP position, i.e. inheritance mode recessive (Rec), in both CCF and UCSF sets showed a significant association with increased risk of MI (P values of 0.049 and 0.029, OR of 1.90 and 1.69, respectively) when compared to females carrying one or no copies of the risk allele (heterozygous and homozygous for the non-risk allele).

An example of a SNP marker where the genotype containing a single copy of the risk allele (i.e. heterozygous) is associated with an increased risk for MI is hCV9326822, a marker in the STX10 gene. Samples from CCF and UCSF were individually genotyped for this SNP (Table 4). In the CCF sample set, 398 cases and 233 controls were genotyped. Cases had a history of MI, while controls had no MI and no stenosis. In the UCSF sample set, 611 cases and 618 controls were genotyped. Cases had a history of MI, while controls had no symptomatic CVD. Individuals with one or two copies of the T allele of this marker, i.e. inheritance mode dominant (Dom), in both CCF and UCSF sets showed a significant association with increased risk of MI (P values of 0.026 and 0.043, OR of 1.52 and 1.29, respectively) when compared to those carrying no copies of the risk allele (homozygous for the non-risk allele), in case and control populations unstratified by phenotype (Stratum "All").

An example of a SNP where the risk allele is associated with an increased risk of MI is hCV2091644, a marker in the VAMP8 gene. Samples from CCF and UCSF were individually genotyped for hCV2091644 (Table 4). In the CCF sample set, 182 cases and 232 controls were genotyped. Cases had a history of MI and were all <60 years old, while controls had no MI, low (<50%) or no stenosis, and were all >60 years old. In the UCSF sample set, 414 cases and 492 controls were genotyped. Cases had a history of MI and were either females<60 or males<55 years old, while controls had no symptomatic CVD and were females>70 or males>65 years old. The C allele of this marker in both CCF and UCSF sets showed a significant association with increased risk of MI (P values of 0.007 and 0.017, OR of 1.48 and 1.26, respectively), in case and control populations unstratified by phenotype (Stratum "All").

A second case-control study for association with CHD, particularly MI, was conducted using the samples obtained from UCSF and CCF as described above. In this study three sequential genotyping analyses were performed in order to confirm the markers' association with MI.

In the first genotyping analysis, UCSF samples were divided into 340 cases and 346 controls. DNA samples from about 50 individuals were pooled, and the pools genotyped for SNP markers by allele-specific PCR, described above. Those SNPs with an observed P value of <0.05 (Fisher Exact test) for association with MI in this analysis were selected as candidates for follow-up genotyping in a second pooled-sample analysis.

In the subsequent genotyping analysis, DNA from the CCF sample set was divided into 445 cases and 606 controls. Cases were males under age 66 and females under age 75 who had a history of MI verified by electrocardiogram, cardiac enzymes or perfusion imaging. Controls had no history of MI and had less than 50% coronary luminal narrowing based on clinical angiography. Of the controls, 81% had stable angina. SNPs in the pooled samples of this secondary analysis that demonstrated the same risk allele as in the first, and had a P value of <0.05 for association with MI, were selected as candidates for individual genotyping in order to further confirm their MI association.

UCSF DNA samples from 560 cases and 891 controls, males and females, were evaluated by individual genotyping. Subjects ranged in age from 52 to 79. Controls had no history of MI, symptomatic vascular disease or diabetes, and did not have a known first-degree relative with a history of symptomatic coronary disease prior to age 65. Of the controls, 10% had undergone cardiac catheterization. Genotyping was performed using OLA, as described above.

Each SNP was analyzed for association with MI by comparing SNP allele or genotype frequencies between cases and controls. To determine association between MI and allele frequencies, the two-tailed Fisher Exact test was used for the first two pooled-sample analyses. For individually genotyped samples, where the a priori hypothesis was that the risk allele for the association matched the risk allele observed in the previous two pooled-sample analyses, risk associations were assessed by the one-tailed Fisher Exact test. Genotypic comparisons of homozygotes to heterozygotes for the risk allele were performed using logistic regression, and the P values from logistic regression were calculated using a Wald test. To correct for multiple testing, the values for false discovery rates, denoted here by $Q_i$ for the $i^{th}$ value in increasing order, were calculated using the MULTTEST procedure (SAS Institute, 2002; Benjamini and Hochberg, 1995) as follows: given m hypotheses $H_1, H_2, \ldots, H_m$ and corresponding P values $P_1, P_2, \ldots, P_m$, the P values are ordered such that $P_{(m)} \geq P_{(m-1)} \geq \ldots \geq P_{(1)}$. Then let $Q_{(m)}=P_{(m)}$, $Q_{(m-1)}=\min(Q_{(m)}, P_{(m-1)} \times [m \div (m-1)]), \ldots, Q_{(m-j)}=\min(Q_{(m-j+1)}, P_{(m-j)} \times [m \div (m-j)]), \ldots, Q_{(1)}=\min(Q_{(2)}, m \times P_{(1)})$.

Five SNP markers are shown to be associated with MI in Tables 5 and 6. Table 5 lists each SNP marker's allelic association with MI, based on the comparison of individual genotyping results from 560 cases and 891 controls. Table 6 lists each SNP marker's genotypic association with MI. The number of cases and controls of each genotype that was analyzed for each SNP marker is indicated. All listed markers demonstrated an association with increased risk of MI when the sample genotype was homozygous for the risk allele (Table 6, P values<0.05). A subset of these markers also demonstrated an association with increased MI risk when the genotype was heterozygous for the risk allele (Table 6, markers for OR13G1 and ZNF627, P values<0.05).

An example of a SNP marker in which the risk allele provides an increased risk of developing MI is hCV1449414, in the OR13G1 gene, with a P value of 0.013 (Table 5). The G allele is associated with an increased risk of MI regardless of whether the individual's genotype was heterozygous or homozygous for the allele, with P values of 0.017 and 0.019, respectively (Table 6).

A second example of a SNP marker in which the risk allele provides an increased risk of developing MI is hCV25992024, in the ZNF627 gene, with a P value of 0.0034 (Table 5). The A allele is associated with an increased risk of MI regardless of whether the individual's genotype was heterozygous or homozygous for this allele, with P values of 0.018 and 0.002, respectively (Table 6).

An example of a SNP marker in which the association with MI risk is greater for individuals with two copies of the risk allele than individuals with one (i.e. homozygotes vs. heterozygotes) is hCV12107274, in the TAS2R50 gene. Individuals with two copies of the risk allele C showed greater association with MI risk than individuals with one copy, with a P value of 0.007 for homozygotes (Table 6).

A second example of a SNP marker in which association with risk of MI is greater for individuals with two copies of the risk allele than for individuals with one is hCV11315168, in the ROS1 gene. Individuals with two copies of the risk allele C showed greater association with MI risk than individuals with one, with a P value of 0.010 for homozygotes (Table 6).

Additional SNPs in five genes in which a SNP was shown to have an association with MI (Tables 4-6) were selected for further testing. These selected SNPs were individually genotyped in UCSF samples divided into cases and controls (see above for a description of this sample set). Genotyping was performed by OLA or allele-specific PCR depending on the assay, as described above. Based on the case and control allele frequencies demonstrated in individual genotyping, the SNP markers in these five genes that demonstrated an association with MI are shown in Table 7, with P values<0.1 and OR>1.0. Allelic P values were determined using the Fisher Exact test; genotypic (dominant/recessive) P values, using the asymptotic chi-square test.

The SNPs presented in Tables 4-7 are shown to be associated with risk for CHD, specifically MI. Other SNPs (such as those presented in Tables 1 and 2), including LD SNPs in the genes listed in Table 4 would also be expected to be useful for the diagnosis, prognosis, etc., of CHD, and particularly MI. All such SNPs associated with CHD may also be useful for predicting a patient's response to therapeutic agents such as statins.

Example 2

Statistical Analysis of SNP Allelic and Genotypic Association with Stenosis Risk A case-control genetic analysis was performed to determine the association of SNPs in the human genome with coronary heart disease (CHD), and in particular stenosis, using genomic DNA from two independently obtained sample sets. One set consisted of individuals from the Cleveland Clinic Foundation (CCF), divided into 782 cases and 254 controls. Cases were individuals with the most severe stenosis, and controls were individuals with no detectable stenosis and no history of MI. The second set of samples were obtained from the University of California at San Francisco (UCSF). This set consisted of DNA from 770 Caucasian individuals, divided into 472 cases and 298 controls. Cases were individuals with the most severe stenosis, and controls were individuals with the least severe stenosis and no history of MI. Stenosis severity was determined in both sample sets by obtaining angiographic measurements of ten coronary artery segments per individual, and ranking the individuals according to these measurements.

DNA was extracted from blood samples at CCF or UCSF, as described above in Example 1. SNP markers in the extracted DNA samples were analyzed by genotyping. Initially, pooling studies were performed, in which DNA samples from about 50 individuals from each sample set were pooled and the allele frequencies for specific markers were obtained by allele-specific PCR, as described in Example 1. SNP markers that were determined in pooling studies to be significantly associated with stenosis were then individually genotyped by a similar method.

The CCF sample set was genotyped first, using pooled samples. SNPs with an observed P value<0.05 for association with stenosis and an odds ratio>1.3 were selected for further genotyping in the second set of pooled samples, from UCSF. Those SNPs with stenosis association to the same risk allele in both pooled-sample studies were individually genotyped in CCF and UCSF samples.

The SNP markers' association with stenosis was calculated, depending on whether a genotype or allelic association was investigated: the Fisher Exact test for allelic association, and asymptotic chi-square test for genotypic association of two different modes of inheritance (dominant and recessive). The magnitude of the allelic or genotypic effect on risk association (effect size) was estimated by the odds ratio (OR).

One validated SNP showing an association with CHD, specifically stenosis, is shown in Table 8. The SNP is considered a validated marker because the association analysis in individual genotyping indicated the same risk allele as in the previous two pooled studies, with P values of less than 0.05. The A risk allele for this SNP marker is associated with stenosis (P values of 0.04 in both sample sets). Additionally, the A allele is dominant for stenosis risk; i.e., genotypic analysis indicates assocation with stenosis when an individual is heterozygous for this allele (Table 8, "Dom").

The SNP marker presented in Table 8 was shown to be associated with risk for CHD, specifically stenosis. Other SNP markers (such as those presented in Tables 1 and 2), including LD SNPs in the gene listed in Table 8 would also be expected to be useful for the diagnosis, prognosis, etc., of CHD, and particularly stenosis. All such SNPs associated with CHD may also be useful for predicting a patient's response to therapeutic agents such as statins.

Example 3

Additional SNPs in LD with CHD-Associated Interrogated SNP Markers

An investigation was conducted to identify SNP markers in linkage disequilibrium (LD) with SNPs which have been found to be associated with CHD, specifically MI and stenosis, as shown in Tables 4-8. Briefly, the power threshold (7) was set at 70% for detecting disease association using LD markers. This power threshold is based on equation (31) above, which incorporates allele frequency data from previous disease association studies, the predicted error rate for not detecting truly disease-associated markers, and a significance level of 0.05. Using this power calculation and the sample size, for each interrogated SNP a threshold level of LD, or $r^2$ value, was derived ($r_T^2$, equations (32) and (33)). The threshold value $r_T^2$ is the minimum value of linkage disequilibrium between the interrogated SNP and its LD SNPs possible such that the non-interrogated SNP still retains a power greater or equal to T for detecting disease-association.

Based on the above methodology, LD SNPs were found for all interrogated SNPs shown in Tables 4-8. LD SNPs are listed in Table 9, each associated with its respective interrogated SNP. Also shown are the public SNP IDs (rs numbers) for interrogated and LD SNPs, the threshold $r^2$ value and the power used to determine this, and the $r^2$ value of linkage disequilibrium between the interrogated SNP and its matching LD SNP. As an example in Table 9, MI-associated SNP hCV11315168 was calculated to be in LD with hCV11315156 at an $r^2$ value of 0.71, based on a 70% power calculation.

Two markers from Table 9 that were calculated to be in LD with CHD-associated SNPs were also analyzed for their association with MI (see the study description in Example 1, SNPs in five genes analyzed for MI association). SNP marker hCV11315171 is in calculated LD with marker hCV11315168, at an $r^2$ value of 1.00; hCV11315231 is in LD with hCV8908863, at an $r^2$ value of 0.63. Data for these two SNP markers are shown in Table 7 of Example 1. Both SNPs demonstrated an association with MI, with P values<0.05.

All publications and patents cited in this specification are herein incorporated by reference in their entirety. Modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 3

| hCV | Alleles | Sequence A (allele-specific primer) | Sequence B (allele-specific primer) | Sequence C (common primer) |
| --- | --- | --- | --- | --- |
| hCV1036123 | C/T | GTCCTACTGCCCCCG (SEQ ID NO: 505) | TGTCCTACTGCCCCCA (SEQ ID NO: 506) | CCCCGGCTCCTCTTATAC (SEQ ID NO: 507) |
| hCV1116793 | C/T | GGAAGGTCATCCTGGG (SEQ ID NO: 508) | GGAAGGTCATCCTGGA (SEQ ID NO: 509) | CGAAGAGTTTCTGTGTGGTACAG (SEQ ID NO: 510) |
| hCV11247694 | A/C | CCTAGAGACTTAGGAAATGCTTT (SEQ ID NO: 511) | CCTAGAGACTTAGGAAATGCTTG (SEQ ID NO: 512) | GGTGGCAGGGTGAAACTCTA (SEQ ID NO: 513) |
| hCV11247713 | A/G | AGCTTAGGGAAAGGAGGAATAAA (SEQ ID NO: 514) | GCTTAGGGAAAGGAGGAATAAG (SEQ ID NO: 515) | GCGGCTGGGACCACTTT (SEQ ID NO: 516) |
| hCV11276368 | C/T | CGCGGAGTGTCAAGAGG (SEQ ID NO: 517) | CGCGGAGTGTCAAGAGA (SEQ ID NO: 518) | GCTGGCAGAGTGCTGTTGA (SEQ ID NO: 519) |
| hCV11315168 | C/G | GTTGTTTGCTTCATCTCTGC (SEQ ID NO: 520) | GTTGTTTGCTTCATCTCTGG (SEQ ID NO: 521) | AGTGCTGGGCTCAAGAAC (SEQ ID NO: 522) |
| hCV11315171 | C/T | ATTTCTGAATAACTGAAGTTGGTC (SEQ ID NO: 523) | ATTTCTGAATAACTGAAGTTGGTT (SEQ ID NO: 524) | AAACTGGCAATAACTCAGATTCT (SEQ ID NO: 525) |
| hCV11315231 | A/G | CCCTTCTGCTTCACCTCTAT (SEQ ID NO: 526) | CCCTTCTGCTTCACCTCTAC (SEQ ID NO: 527) | CTCCTACAACTCTTGCATTAGCATAAGA (SEQ ID NO: 528) |
| hCV11563866 | C/G | ATATTACAGTGGAAAAGAAGGG (SEQ ID NO: 529) | ATATTACAGTGGAAAAGAAGGC (SEQ ID NO: 530) | ATTATGGCTGTTCTCAAACTTG (SEQ ID NO: 531) |
| hCV11987864 | C/T | CCAGCAGTGATGTGC (SEQ ID NO: 532) | ACCAGCAGTGATGTGT (SEQ ID NO: 533) | GCCTCAGCAGGACTTCTATG (SEQ ID NO: 534) |
| hCV12107274 | C/T | TGATGCTAATCTGTTCTCTGTG (SEQ ID NO: 535) | TCTGATGCTAATCTGTTCTCTGTA (SEQ ID NO: 536) | ATAACAAGAGGAAGGAGATCAGA (SEQ ID NO: 537) |

TABLE 3-continued

| hCV | Alleles | Sequence A (allele-specific primer) | Sequence B (allele-specific primer) | Sequence C (common primer) |
|---|---|---|---|---|
| hCV1283127 | C/G | CAGGCATGACATTGAAAC (SEQ ID NO: 538) | CAGGCATGACATTGAAAG (SEQ ID NO: 539) | CAGAATGTAGTCTCGATTCTTCTTC (SEQ ID NO: 540) |
| hCV1328901 | C/T | GAGCAGTGAATCAGGTTAAC (SEQ ID NO: 541) | GAGCAGTGAATCAGGTTAAT (SEQ ID NO: 542) | GGCCCTTGTTGGTGTCTTA (SEQ ID NO: 543) |
| hCV1449414 | T/C | ACACACATATGGTGGTTCATAAT (SEQ ID NO: 544) | CACACATATGGTGGTTCATAAC (SEQ ID NO: 545) | CATGTCCCAGCTCTTCTTG (SEQ ID NO: 546) |
| hCV15752716 | C/T | ACGCTGCTGTTCCG (SEQ ID NO: 547) | ACGCTGCTGTTCCA (SEQ ID NO: 548) | CAGACAGACAACAATTCAGAAGAA (SEQ ID NO: 549) |
| hCV15770510 | C/T | ACGGCATCTTCTATCCG (SEQ ID NO: 550) | CACGGCATCTTCTATCCA (SEQ ID NO: 551) | CCAGCTGGTGGTGAGTG (SEQ ID NO: 552) |
| hCV15807798 | C/T | GCTTGGAACTTTCCATGC (SEQ ID NO: 553) | GGCTTGGAACTTTCCATGT (SEQ ID NO: 554) | CCTTTAACAGTCCCTGCTACTT (SEQ ID NO: 555) |
| hCV15885108 | A/C | ATGAGCAGACTCTAAGCTGA (SEQ ID NO: 556) | GAGCAGACTCTAAGCTGC (SEQ ID NO: 557) | TGAGTGCCTGGGGAAGTT (SEQ ID NO: 558) |
| hCV15954965 | A/G | ATGCTCAAATGGGAAAGATGAT (SEQ ID NO: 559) | TGCTCAAATGGGAAAGATGAC (SEQ ID NO: 560) | CATTACATTGCCTATCAGTGCAGTTAAGT (SEQ ID NO: 561) |
| hCV15965459 | A/T | CAGCCTCAGGAGATAACAGT (SEQ ID NO: 562) | CAGCCTCAGGAGATAACAGA (SEQ ID NO: 563) | TCAACCCTTTTCCACATAGAT (SEQ ID NO: 564) |
| hCV16189747 | A/C | ATGGACTCCTGAAGAAGCA (SEQ ID NO: 565) | TGGACTCCTGAAGAAGCC (SEQ ID NO: 566) | TCAGTCCGCTGCCTTGTTAT (SEQ ID NO: 567) |
| hCV16196618 | C/G | ATTAGCCCCAAAGCGTAC (SEQ ID NO: 568) | ATTAGCCCCAAAGCGTAG (SEQ ID NO: 569) | GCTTTAGAAGGCTGGATATTTATG (SEQ ID NO: 570) |
| hCV1635402 | A/G | AACTCATCAAGATTTATGCTTCA (SEQ ID NO: 571) | ACTCATCAAGATTTATGCTTCG (SEQ ID NO: 572) | CTACTCAGGCCAGTCTTGTTACT (SEQ ID NO: 573) |
| hCV1639780 | C/G | GCCTACAGAAAGATTTCACAAAAC (SEQ ID NO: 574) | GCCTACAGAAAGATTTCACAAAAG (SEQ ID NO: 575) | AGGACTCTCAGACCCTTCCTAAATA (SEQ ID NO: 576) |
| hCV1690777 | A/G | GGCTTTACAGAAGGAAATGCT (SEQ ID NO: 577) | GCTTTACAGAAGGAAATGCC (SEQ ID NO: 578) | GCATGCGCTGAATTTTATATAG (SEQ ID NO: 579) |
| hCV1741111 | C/T | CCTCAGAATGGCCAAAAAC (SEQ ID NO: 580) | CCTCAGAATGGCCAAAAAT (SEQ ID NO: 581) | CCAGGCAGCCAGACTTCT (SEQ ID NO: 582) |
| hCV1801149 | A/G | GAGAGTCGCAGGGTATTTTAA (SEQ ID NO: 583) | GAGAGTCGCAGGGTATTTTAG (SEQ ID NO: 584) | AAAGGCCCAGGCTCTAGA (SEQ ID NO: 585) |
| hCV1913911 | C/G | CTAGCAAAGCACACAAATGAC (SEQ ID NO: 586) | CTAGCAAAGCACACAAATGAG (SEQ ID NO: 587) | GGATGAAGTTTTTGAAACACAC (SEQ ID NO: 588) |
| hCV192122 | C/T | CTTTCTGTTTATCTGTGTTTCTTATC (SEQ ID NO: 589) | CTTTCTGTTTATCTGTGTTTCTTATT (SEQ ID NO: 590) | GCACAGCCATAATGAACAATA (SEQ ID NO: 591) |
| hCV202800 | C/T | GGCTATAATGGAATGAATCTTAACAG (SEQ ID NO: 592) | GGCTATAATGGAATGAATCTTAACAA (SEQ ID NO: 593) | GATGGATCAAGCACTTTACCAACTCA (SEQ ID NO: 594) |
| hCV2091601 | C/G | GGAATGGGTCAAGAATGTTCC (SEQ ID NO: 595) | GGAATGGGTCAAGAATGTTCG (SEQ ID NO: 596) | GGCCCAAGGCAAAGGATTTT (SEQ ID NO: 597) |
| hCV2091606 | A/G | CCCAGCCTATTCTTAATCCTATTTTA (SEQ ID NO: 598) | CCAGCCTATTCTTAATCCTATTTTG (SEQ ID NO: 599) | TCCTAGCAATTCCCTGTGTGATA (SEQ ID NO: 600) |
| hCV2091642 | A/G | CGTTCTTCCACCAGAATTTT (SEQ ID NO: 601) | CGTTCTTCCACCAGAATTTC (SEQ ID NO: 602) | GGGCTGCACTTGTACTCTTATAAT (SEQ ID NO: 603) |
| hCV2091643 | C/T | GGAGGGTTGTCCCTGAAG (SEQ ID NO: 604) | GGAGGGTTGTCCCTGAAA (SEQ ID NO: 605) | GGTGGAAGAACGTGAAGATGATTGT (SEQ ID NO: 606) |
| hCV2091644 | C/T | TTCTGGGGCATACAACG (SEQ ID NO: 607) | CTTCTGGGGCATACAACA (SEQ ID NO: 608) | AGGGACAACCCTCCATAAA (SEQ ID NO: 609) |
| hCV2091655 | C/T | AGAATGGCGTCTACCCAG (SEQ ID NO: 610) | AGAATGGCGTCTACCCAA (SEQ ID NO: 611) | CAGGTAGCTTGGTTACCCATTCTT (SEQ ID NO: 612) |

TABLE 3-continued

| hCV | Alleles | Sequence A (allele-specific primer) | Sequence B (allele-specific primer) | Sequence C (common primer) |
|---|---|---|---|---|
| hCV2100197 | C/T | TGTGAAGATCCAAACCACTC (SEQ ID NO: 613) | TGTGAAGATCCAAACCACTT (SEQ ID NO: 614) | TGAGCCATCCATCTTCTACA (SEQ ID NO: 615) |
| hCV2100250 | C/T | GTATGTAGTAAATAGTTAATAAAGGAGTGATAC (SEQ ID NO: 616) | GGTATGTAGTAAATAGTTAATAAAGGAGTGATAT (SEQ ID NO: 617) | AAAGATACTAGCCATATCATTACATGTGTG (SEQ ID NO: 618) |
| hCV2169762 | G/T | CGAGTCGGTCTGCTGC (SEQ ID NO: 619) | CGAGTCGGTCTGCTGA (SEQ ID NO: 620) | TGCCTACCTCATTCCATCTG (SEQ ID NO: 621) |
| hCV25605409 | A/C | CAAAACAGAAGAGCAAGATGA (SEQ ID NO: 622) | AAAACAGAAGAGCAAGATGC (SEQ ID NO: 623) | TTTTGGTTCGATGGATGTT (SEQ ID NO: 624) |
| hCV25609987 | A/G | GAGCAGGTAGCCTGTATTT (SEQ ID NO: 625) | GAGCAGGTAGCCTGTATTC (SEQ ID NO: 626) | TGCTGCCTTGGTTGTGA (SEQ ID NO: 627) |
| hCV25611853 | G/T | AGGACTGGATGAAATGAGTG (SEQ ID NO: 628) | AAGGACTGGATGAAATGAGTT (SEQ ID NO: 629) | GCCAGAGCAGAGTGACATCT (SEQ ID NO: 630) |
| hCV25623749 | G/C | CCAGAGAAGTCCAACGC (SEQ ID NO: 631) | CCAGAGAAGTCCAACGG (SEQ ID NO: 632) | GACCTCCCTGACCTACTTAGAC (SEQ ID NO: 633) |
| hCV25626077 | C/T | GGGTTTTGGTTCTTACCACAC (SEQ ID NO: 634) | GGGTTTTGGTTCTTACCACAT (SEQ ID NO: 635) | GGCTGAGGTTCTCATCCAGTAA (SEQ ID NO: 636) |
| hCV25628370 | C/T | CTGAGACAAAATTGAGGAAGC (SEQ ID NO: 637) | GCTGAGACAAAATTGAGGAAGT (SEQ ID NO: 638) | TGAAACATCAAACAAGAAATCAGT (SEQ ID NO: 639) |
| hCV25641925 | A/G | GCGTGATCGCAAGAGTCT (SEQ ID NO: 640) | CGTGATCGCAAGAGTCC (SEQ ID NO: 641) | GGGTGTCTGCTGCATCTACT (SEQ ID NO: 642) |
| hCV25651109 | C/G | GGTCCTGCTTGATGCG (SEQ ID NO: 643) | AGGTCCTGCTTGATGCC (SEQ ID NO: 644) | CGACCATGGACATTCACAT (SEQ ID NO: 645) |
| hCV25928538 | C/G | TCCACTGTTTTTGAACGC (SEQ ID NO: 646) | TCCACTGTTTTTGAACGG (SEQ ID NO: 647) | TAATTGCAAGAATATTGAAAGACA (SEQ ID NO: 648) |
| hCV25935078 | C/T | CTTCCAGATCCTCTGTCTTG (SEQ ID NO: 649) | GCTTCCAGATCCTCTGTCTTA (SEQ ID NO: 650) | CCAGTGAAGGTGGAGGAAATGATC (SEQ ID NO: 651) |
| hCV25937808 | A/G | AGAAGCTGAAAGGACCACTT (SEQ ID NO: 652) | GAAGCTGAAAGGACCACTC (SEQ ID NO: 653) | CTTCTGGAATTTGGTTTCCTGTTTCTTAG (SEQ ID NO: 654) |
| hCV25951678 | A/G | AATGCAGCTGCTCAAAGA (SEQ ID NO: 655) | ATGCAGCTGCTCAAAGG (SEQ ID NO: 656) | GTTCCCGGGCTCACA (SEQ ID NO: 657) |
| hCV25959434 | C/G | CCAGGAGCCCTCCAAG (SEQ ID NO: 658) | CCAGGAGCCCTCCAAC (SEQ ID NO: 659) | GGCCTCTTCCACTCACTAAA (SEQ ID NO: 660) |
| hCV25965660 | A/G | GGCCTGGTGGAAGTGAT (SEQ ID NO: 661) | GGCCTGGTGGAAGTGAC (SEQ ID NO: 662) | GGCTGACCGTCATCCAC (SEQ ID NO: 663) |
| hCV25992024 | G/A | TTACAGGGTCTTTCTCCACC (SEQ ID NO: 664) | TCTTACAGGGTCTTTCTCCACT (SEQ ID NO: 665) | AGAGAAACCCCATGAAAGTAAG (SEQ ID NO: 666) |
| hCV26490082 | A/G | GGCTTGTTCCTGTTGGAA (SEQ ID NO: 667) | GGCTTGTTCCTGTTGGAG (SEQ ID NO: 668) | TCAAGGTGGGAGAAAGAGATGT (SEQ ID NO: 669) |
| hCV26809148 | A/G | CATCATGGTGTTCTTGCCT (SEQ ID NO: 670) | ATCATGGTGTTCTTGCCC (SEQ ID NO: 671) | CATTATCTGAAATGTTTCATTGTAGA (SEQ ID NO: 672) |
| hCV2731349 | A/G | TGGCAAACCATGGGTA (SEQ ID NO: 673) | GGCAAACCATGGGTG (SEQ ID NO: 674) | TGGAACCCACTTTCTTTCTTAC (SEQ ID NO: 675) |
| hCV27484788 | A/T | GAAATGCTTGTTTCTTTCTAAATTGTA (SEQ ID NO: 676) | GAAATGCTTGTTTCTTTCTAAATTGTT (SEQ ID NO: 677) | CCAACAATAGAGAAGCAGACAAATATTC (SEQ ID NO: 678) |
| hCV28026155 | C/G | GAGGGAGACTTGGTTGTCC (SEQ ID NO: 679) | AGGGAGACTTGGTTGTCG (SEQ ID NO: 680) | CCTAATTAGGAAGCAAATTCATTC (SEQ ID NO: 681) |
| hCV29281059 | G/T | CTCATCTCTCTCTAGGCTAGTG (SEQ ID NO: 682) | CTCATCTCTCTCTAGGCTAGTT (SEQ ID NO: 683) | GGGACCGCTGGTCTATAGTAC (SEQ ID NO: 684) |
| hCV2930693 | A/C | CGAAGAAGTACAACCCACAT (SEQ ID NO: 685) | CGAAGAAGTACAACCCACAG (SEQ ID NO: 686) | GACACATGTAAGTTCCACTCATATG (SEQ ID NO: 687) |

TABLE 3-continued

| hCV | Alleles | Sequence A (allele-specific primer) | Sequence B (allele-specific primer) | Sequence C (common primer) |
|---|---|---|---|---|
| hCV30375335 | A/G | CACTCACTGGCATTTTCTTCTAT (SEQ ID NO: 688) | ACTCACTGGCATTTTCTTCTAC (SEQ ID NO: 689) | CTTGTGGAAAGAAGTAGGGCAAATATCA (SEQ ID NO: 690) |
| hCV3049077 | C/T | CAAACCACTTAGTACCACTAGATG (SEQ ID NO: 691) | TCAAACCACTTAGTACCACTAGATA (SEQ ID NO: 692) | TTCTCATAAAGGCTCACCCAGGAAA (SEQ ID NO: 693) |
| hCV30555387 | C/T | GCTAAACTTATCTTTGACTGATTACAG (SEQ ID NO: 694) | GCTAAACTTATCTTTGACTGATTACAA (SEQ ID NO: 695) | GGAGTTAGGAAGTGCTTTGCAGAAA (SEQ ID NO: 696) |
| hCV3108768 | C/T | TCCACTTGGTACTTGGGG (SEQ ID NO: 697) | ATCCACTTGGTACTTGGGA (SEQ ID NO: 698) | CCGCTGTGGCAACTATGTACTAC (SEQ ID NO: 699) |
| hCV3108811 | C/T | GAAACTAAAAGGGTCAAGAATAGC (SEQ ID NO: 700) | GGAAACTAAAAGGGTCAAGAATAGT (SEQ ID NO: 701) | CCAACCCCAATACCACATAGTTT (SEQ ID NO: 702) |
| hCV31258057 | G/T | AGTGCAGGGTGGATGAC (SEQ ID NO: 703) | AGTGCAGGGTGGATGAA (SEQ ID NO: 704) | CTCCTCTGGGGACTCTCAACT (SEQ ID NO: 705) |
| hCV3130332 | A/G | AGTTTATCTGTGCTCCCTAATTAA (SEQ ID NO: 706) | AGTTTATCTGTGCTCCCTAATTAG (SEQ ID NO: 707) | CCTGCTCCTTGCTGATG (SEQ ID NO: 708) |
| hCV3137630 | A/C | AACCTGAAAGCCACGTAGAT (SEQ ID NO: 709) | ACCTGAAAGCCACGTAGAG (SEQ ID NO: 710) | CTGTCCAGAAATCATTCATCAT (SEQ ID NO: 711) |
| hCV3180404 | A/G | ACAGCAGAGCAGCCTTAA (SEQ ID NO: 712) | ACAGCAGAGCAGCCTTAG (SEQ ID NO: 713) | AGTGATGCTGGAAGCACTTCT (SEQ ID NO: 714) |
| hCV3181997 | A/G | TGGATCCTGACTTTGTGAAAT (SEQ ID NO: 715) | TGGATCCTGACTTTGTGAAAC (SEQ ID NO: 716) | GGAATCTGAAGGAGACATTTTTAC (SEQ ID NO: 717) |
| hCV3225041 | A/G | AACAGGAGTTTGAACTTGGTT (SEQ ID NO: 718) | AACAGGAGTTTGAACTTGGTC (SEQ ID NO: 719) | CAGGGAAGGACGGCCTAATATCA (SEQ ID NO: 720) |
| hCV3225044 | G/A | ACGTGCTGGTGGGAG (SEQ ID NO: 721) | ACGTGCTGGTGGGAA (SEQ ID NO: 722) | CCTCCTGGAGCAGCTATTC (SEQ ID NO: 723) |
| hCV323070 | A/G | GCCCAGAAAGATGAGTTCA (SEQ ID NO: 724) | GCCCAGAAAGATGAGTTCG (SEQ ID NO: 725) | TGTCCCTTTTTCAGAGACATAGAT (SEQ ID NO: 726) |
| hCV323071 | A/G | AAACCAGGATATCAGAACATTTTA (SEQ ID NO: 727) | ACCAGGATATCAGAACATTTTG (SEQ ID NO: 728) | GGTCTTAGGAATTATCTGACATCTT (SEQ ID NO: 729) |
| hCV49128 | G/T | CTTGGCCTTCTCAGGAAC (SEQ ID NO: 730) | CTTGGCCTTCTCAGGAAA (SEQ ID NO: 731) | AACATTCTGCCCATCACAGACATTC (SEQ ID NO: 732) |
| hCV505516 | A/T | CACCATGGTGAACACAAATAA (SEQ ID NO: 733) | CACCATGGTGAACACAAATAT (SEQ ID NO: 734) | CCGCTCCAACCAACCTTTA (SEQ ID NO: 735) |
| hCV7422490 | C/T | GCATGAAACATGGGATTGTATAC (SEQ ID NO: 736) | AGCATGAAACATGGGATTGTATAT (SEQ ID NO: 737) | ACACTCCTGGCCCTTATTTATACTC (SEQ ID NO: 738) |
| hCV7425232 | C/T | TCAAAATTATTTCTTGCTACAGG (SEQ ID NO: 739) | GTCAAAATTATTTCTTGCTACAGA (SEQ ID NO: 740) | TCCTCCAGCCTCTCATTC (SEQ ID NO: 741) |
| hCV7425242 | C/T | TGGATGGCTGTGATTACAAC (SEQ ID NO: 742) | TTGGATGGCTGTGATTACAAT (SEQ ID NO: 743) | GGCATAGTTCAGCCAAGTTCT (SEQ ID NO: 744) |
| hCV81794 | C/T | TGTCATATATGGTTTATTTACTACAAC (SEQ ID NO: 745) | TGTCATATATGGTTTATTTACTACAAT (SEQ ID NO: 746) | TGACCCAGCAACTGAGTGTA (SEQ ID NO: 747) |
| hCV8367080 | C/T | CCAGCCTTCCCTTTTTC (SEQ ID NO: 748) | CCAGCCTTCCCTTTTTT (SEQ ID NO: 749) | AGAGAGAAGGACACAATGTGAG (SEQ ID NO: 750) |
| hCV881283 | C/G | AGACACACAGGACACATG (SEQ ID NO: 751) | AGACACACAGGACACATC (SEQ ID NO: 752) | TTCTGCTCCCAGAACTAG (SEQ ID NO: 753) |
| hCV8908863 | C/G | CAAGCAAGTTTCTCAAAGATTATTTATTC (SEQ ID NO: 754) | AAGCAAGTTTCTCAAAGATTATTTATTG (SEQ ID NO: 755) | GGAAATTACTCCACCCTCTATTAGTG (SEQ ID NO: 756) |
| hCV8908875 | A/G | CATTTGCTGTGCATGTGTTTA (SEQ ID NO: 757) | TTTGCTGTGCATGTGTTTG (SEQ ID NO: 758) | TGGGAAGATTTAACAAGGAATAAGAAGA (SEQ ID NO: 759) |
| hCV9302071 | A/G | TATTCATGAACACCAGGAATTAAAATT (SEQ ID NO: 760) | TTCATGAACACCAGGAATTAAAATC (SEQ ID NO: 761) | CTTACCACCCCTGGAAACACTTAGT (SEQ ID NO: 762) |

TABLE 3-continued

| hCV | Alleles | Sequence A (allele-specific primer) | Sequence B (allele-specific primer) | Sequence C (common primer) |
|---|---|---|---|---|
| hCV9326822 | C/T | CTCGGGACCAGTCCAG (SEQ ID NO: 763) | CTCGGGACCAGTCCAA (SEQ ID NO: 764) | CCGACAGCCGAGGAGA (SEQ ID NO: 765) |
| hCV945276 | G/T | CGCCACAAACACATACCTG (SEQ ID NO: 766) | CGCCACAAACACATACCTT (SEQ ID NO: 767) | CCGCTGCTTGGAACAG (SEQ ID NO: 768) |
| hDV69288445 | A/C | AAGCCCTGCACATTTTATCTT (SEQ ID NO: 769) | AGCCCTGCACATTTTATCTG (SEQ ID NO: 770) | GCAGTGAAAGCCTGCATTAGAGA (SEQ ID NO: 771) |
| hDV70327769 | A/T | TCAAGAGACCTATGTTGGAGT (SEQ ID NO: 772) | GTCAAGAGACCTATGTTGGAGA (SEQ ID NO: 773) | CATTGTGGAAGGCTTTGGCTATCT (SEQ ID NO: 774) |
| hDV72090975 | C/T | CAAGGAGCACAGCATCTG (SEQ ID NO: 775) | ACAAGGAGCACAGCATCTA (SEQ ID NO: 776) | CAAGCAGGAGAGAGTGTGTAACT (SEQ ID NO: 777) |
| hDV72090986 | G/T | GGGAGAGGGCAACATTC (SEQ ID NO: 778) | GGGGAGAGGGCAACATTA (SEQ ID NO: 779) | CCTTAGACAACCGTTTCCAGAGTAGA (SEQ ID NO: 780) |
| hDV72091004 | C/G | AAACTAGCACGAGAAAAGGAG (SEQ ID NO: 781) | AAACTAGCACGAGAAAAGGAC (SEQ ID NO: 782) | CAGCCAAGGCTGGTGACAC (SEQ ID NO: 783) |

TABLE 4

| SNP Marker Identifier | Gene Symbol | Risk Allele | CCF Design | CCF Case | CCF Cont | CCF Stratum | CCF Mode | CCF P val | CCF OR | UCSF Design | UCSF Case | UCSF Cont | UCSF Stratum | UCSF Mode | UCSF P val | UCSF OR |
|---|---|---|---|---|---|---|---|---|---|---|---|---|---|---|---|---|
| hCV1116793 | none | C | C | 173 | 371 | All | Rec | 0.07 | 1.42 | B | 489 | 414 | All | Rec | 0.05 | 1.31 |
| hCV11276368 | MKI67 | C | G | 460 | 590 | All | Rec | 0.02 | 1.44 | A | 768 | 971 | All | Rec | 0.02 | 1.33 |
| hCV11563866 | OR2A25 | G | D | 184 | 235 | All | Allelic | 0.00 | 1.50 | B | 505 | 456 | All | Allelic | 0.06 | 1.19 |
| hCV11987864 | none | T | C | 200 | 432 | All | Dom | 0.02 | 1.16 | B | 527 | 475 | All | Dom | 0.00 | 1.18 |
| hCV1283127 | none | C | F | 287 | 121 | M | Allelic | 0.08 | 1.34 | A | 462 | 402 | M | Allelic | 0.07 | 1.21 |
| hCV1328901 | SLC26A8 | C | F | 459 | 243 | All | Allelic | 0.07 | 1.24 | A | 767 | 972 | All | Allelic | 0.06 | 1.14 |
| hCV15752716 | HPS1 | T | F | 339 | 109 | S+ | Allelic | 0.00 | 2.12 | A | 490 | 432 | S+ | Allelic | 0.02 | 1.45 |
| hCV15770510 | ALOX12B | T | F | 459 | 588 | All | Allelic | 0.04 | 1.27 | A | 687 | 936 | All | Allelic | 0.06 | 1.19 |
| hCV15807798 | none | C | G | 458 | 589 | All | Rec | 0.10 | 1.57 | A | 762 | 936 | All | Allelic | 0.01 | 1.25 |
| hCV15965459[1] | ZNF350 | A | F | 321 | 136 | BM | Allelic | 0.09 | 1.47 | A | 404 | 316 | All | Rec | 0.05 | 6.36 |
| hCV16189747 | SNX19 | C | G | 446 | 577 | All | Rec | 0.09 | 1.24 | A | 740 | 951 | All | Rec | 0.06 | 1.21 |
| hCV16196618 | EIF2AK2 | C | F | 458 | 245 | All | Allelic | 0.06 | 1.81 | A | 764 | 973 | All | Allelic | 0.00 | 1.74 |
| hCV1635402 | CTNNA3 | A | F | 449 | 240 | All | Rec | 0.09 | 1.38 | A | 511 | 315 | Y | Rec | 0.08 | 1.36 |
| hCV1690777 | NFIB | A | F | 290 | 132 | BM | Allelic | 0.01 | 2.95 | A | 399 | 314 | All | Allelic | 0.10 | 1.61 |
| hCV1741111 | GJA4 | C | F | 425 | 164 | BP+ | Rec | 0.07 | 1.40 | A | 444 | 323 | BP+ | Allelic | 0.07 | 1.23 |
| hCV1801149[2] | MKI67 | G | G | 415 | 569 | All | Rec | 0.04 | 1.42 | A | 757 | 959 | All | Rec | 0.01 | 1.36 |
| hCV1913911 | none | G | G | 287 | 354 | M | Allelic | 0.02 | 1.31 | A | 447 | 386 | M | Allelic | 0.00 | 1.34 |
| hCV192122 | none | C | G | 278 | 352 | M | Dom | 0.02 | 1.66 | A | 258 | 526 | S− | Dom | 0.07 | 1.44 |
| hCV2091644 | VAMP8 | C | D | 182 | 232 | All | Allelic | 0.01 | 1.48 | B | 414 | 492 | All | Allelic | 0.02 | 1.26 |
| hCV2169762 | HPSE2 | T | F | 455 | 243 | All | Dom | 0.00 | 1.61 | A | 769 | 972 | All | Dom | 0.02 | 1.25 |
| hCV25605409 | C10orf28 | C | G | 286 | 358 | M | Dom | 0.01 | 1.56 | A | 458 | 400 | M | Dom | 0.03 | 1.36 |
| hCV25609987 | WDR31 | G | G | 460 | 590 | All | Allelic | 0.07 | 1.42 | A | 764 | 939 | All | Allelic | 0.02 | 1.37 |
| hCV25611853 | GBGT1 | G | F | 475 | 268 | All | Allelic | 0.09 | 1.49 | A | 793 | 1000 | All | Allelic | 0.08 | 1.30 |
| hCV25623749 | PIGX | G | G | 415 | 569 | All | Allelic | 0.00 | 1.64 | A | 757 | 923 | All | Allelic | 0.04 | 1.24 |
| hCV25628370 | none | C | F | 475 | 268 | All | Rec | 0.10 | 1.20 | A | 793 | 1000 | All | Rec | 0.01 | 1.22 |
| hCV25641925 | KCNK13 | A | E | 287 | 605 | M | Dom | 0.04 | 1.61 | A | 461 | 402 | M | Dom | 0.05 | 1.52 |
| hCV25651109 | SLC39A7 | G | G | 460 | 590 | All | Rec | 0.04 | 1.62 | A | 764 | 933 | All | Rec | 0.06 | 1.37 |
| hCV25928538 | none | G | G | 459 | 590 | All | Allelic | 0.02 | 1.51 | A | 768 | 973 | All | Allelic | 0.00 | 1.60 |
| hCV25951678 | FCRLM2 | A | F | 460 | 246 | All | Allelic | 0.09 | 1.80 | A | 767 | 973 | All | Allelic | 0.03 | 1.32 |
| hCV25959434 | FLJ42486 | C | G | 475 | 619 | All | Dom | 0.08 | >1 | A | 793 | 1000 | All | Dom | 0.08 | 3.53 |
| hCV25965660 | MYOM3 | A | F | 458 | 244 | All | Dom | 0.01 | 5.14 | A | 768 | 971 | All | Allelic | 0.07 | 1.20 |
| hCV2731349 | none | A | G | 287 | 357 | M | Dom | 0.09 | 1.42 | A | 313 | 645 | BP− | Dom | 0.10 | 1.32 |
| hCV2930693 | none | A | C | 185 | 404 | All | Allelic | 0.04 | 1.37 | B | 202 | 270 | FM | Allelic | 0.04 | 1.40 |
| hCV3137630 | VTI1A | A | E | 285 | 605 | M | Dom | 0.01 | 1.51 | A | 756 | 911 | All | Dom | 0.03 | 1.28 |
| hCV3180404 | COG2 | A | G | 475 | 619 | All | Dom | 0.08 | 1.28 | A | 793 | 1000 | All | Dom | 0.08 | 1.14 |
| hCV3181997 | none | A | G | 414 | 567 | All | Allelic | 0.04 | 1.22 | A | 757 | 964 | All | Allelic | 0.06 | 1.14 |
| hCV3185278[3] | XRRA1 | C | F | 458 | 246 | All | Allelic | 0.08 | 1.25 | A | 765 | 939 | All | Allelic | 0.02 | 1.21 |
| hCV7425232 | MYH15 | C | G | 170 | 226 | FM | Rec | 0.05 | 1.90 | A | 300 | 553 | FM | Rec | 0.03 | 1.69 |
| hCV81794 | TMPRSS11B | T | F | 435 | 235 | All | Rec | 0.01 | 3.52 | A | 658 | 802 | All | Allelic | 0.02 | 1.23 |
| hCV8367080 | SGIP1 | T | F | 171 | 123 | FM | Rec | 0.02 | 4.13 | A | 785 | 980 | All | Rec | 0.00 | 1.64 |
| hCV881283 | PRKG1 | G | G | 459 | 589 | All | Allelic | 0.03 | 1.72 | A | 769 | 975 | All | Allelic | 0.04 | 1.42 |
| hCV9326822 | STX10 | T | F | 398 | 233 | All | Dom | 0.03 | 1.52 | A | 611 | 618 | All | Dom | 0.04 | 1.29 |

TABLE 4-continued

| SNP Marker Identifier | Gene Symbol | Risk Allele | Design | CCF | | | | | | UCSF | | | | | | |
|---|---|---|---|---|---|---|---|---|---|---|---|---|---|---|---|---|
| | | | | Case | Cont | Stratum | Mode | P val | OR | Design | Case | Cont | Stratum | Mode | P val | OR |
| hCV945276 | KRT5 | T | D | 183 | 232 | All | Rec | 0.08 | 1.52 | B | 294 | 183 | All | Rec | 0.04 | 1.67 |
| hCV9626088[4] | none | A | G | 455 | 588 | All | Allelic | 0.03 | 1.24 | A | 767 | 959 | All | Allelic | 0.02 | 1.19 |

[1] hCV15965459 and hCV22274416 are directed to identical SNP markers.
[2] hCV1801149 and hCV25473208 are directed to identical SNP markers.
[3] hCV3185278 and hCV28026155 are directed to identical SNP markers.
[4] hCV9626088 and hCV26809148 are directed to identical SNP markers.

Stratum Key:
BM   BMI >= 27 kg/m$^2$
BP+  Hypertension
BP−  No hypertension
FM   Female
M    Male
S+   Smoking
S−   Nonsmoking
Y    Age <60

Design Key:
A   Cases with MI vs. controls with no CVD
B   Younger cases with MI (female <60, male <55) vs. Older controls with no CVD (female >70, male >65)
C   Younger cases with MI (<60) vs. Older controls with no MI (>60)
D   Younger cases with MI (<60) vs. Older cases with no MI and low or no stenosis (>60)
E   Cases with MI vs. Controls with no MI
F   Cases with MI vs. Controls with no MI and no stenosis
G   Cases with MI vs. Controls with no MI and low or no stenosis

TABLE 5

| Gene Symbol | SNP Marker Identifier | Risk Allele | P value | OR | OR 90% CI |
|---|---|---|---|---|---|
| KIAA0992 (palladin) | hCV323070 | G | 0.0028 | 1.25 | 1.10-1.43 |
| ROS1 | hCV11315168 | C | 0.0120 | 1.23 | 1.06-1.42 |
| TAS2R50 | hCV12107274 | C | 0.0018 | 1.28 | 1.11-1.46 |
| OR13G1 | hCV1449414 | G | 0.0130 | 1.19 | 1.05-1.36 |
| ZNF627 | hCV25992024 | A | 0.0034 | 1.25 | 1.09-1.44 |

TABLE 6

| Gene Symbol | SNP Marker Identifier | Genotype | Cases | Controls | OR | P value |
|---|---|---|---|---|---|---|
| KIAA0992 (palladin) | hCV323070 | AA | 73 | 132 | | |
| | | GA | 233 | 430 | 0.98 | 0.470 |
| | | GG | 253 | 326 | 1.40 | 0.024 |
| ROS1 | hCV11315168 | GG | 298 | 522 | | |
| | | GC | 213 | 324 | 1.15 | 0.110 |
| | | CC | 40 | 40 | 1.75 | 0.010 |
| TAS2R50 | hCV12107274 | TT | 54 | 116 | | |
| | | CT | 226 | 396 | 1.23 | 0.140 |
| | | CC | 273 | 372 | 1.58 | 0.007 |
| OR13G1 | hCV1449414 | AA | 154 | 293 | | |
| | | AG | 286 | 416 | 1.31 | 0.017 |
| | | GG | 113 | 154 | 1.40 | 0.019 |
| ZNF627 | hCV25992024 | GG | 49 | 118 | | |
| | | AG | 224 | 359 | 1.50 | 0.018 |
| | | AA | 285 | 405 | 1.69 | 0.002 |

TABLE 7

| SNP Marker Identifier | Gene Symbol | Risk Allele | Design | Cases | Controls | Mode | P value | OR |
|---|---|---|---|---|---|---|---|---|
| hCV15885108 | MYH15 | A | B | 500 | 459 | Dom | 0.051 | 1.4 |
| hCV1639780 | MYH15 | G | A | 762 | 972 | Dom | 0.082 | 1.2 |
| hCV202800 | MYH15 | T | A | 767 | 977 | Allelic | 0.006 | 1.2 |
| hCV25937808 | MYH15 | G | A | 768 | 974 | Rec | 0.059 | 3.2 |
| hCV29281059 | MYH15 | G | B | 497 | 458 | Dom | 0.039 | 1.7 |
| hCV30375335 | MYH15 | G | B | 501 | 456 | Dom | 0.006 | 1.6 |

TABLE 7-continued

| SNP Marker Identifier | Gene Symbol | Risk Allele | Design | Cases | Controls | Mode | P value | OR |
|---|---|---|---|---|---|---|---|---|
| hCV3049077 | MYH15 | C | B | 500 | 460 | Dom | 0.033 | 1.7 |
| hCV30555387 | MYH15 | C | B | 504 | 461 | Rec | 0.084 | 1.8 |
| hCV7422490 | MYH15 | T | A | 768 | 973 | Allelic | 0.033 | 1.5 |
| hCV7425242 | MYH15 | C | B | 501 | 460 | Rec | 0.098 | 1.3 |
| hCV9302071 | MYH15 | A | B | 502 | 458 | Rec | 0.024 | 1.3 |
| hDV69288445 | MYH15 | C | A | 765 | 977 | Rec | 0.046 | 1.3 |
| hDV70327769 | MYH15 | T | A | 767 | 973 | Dom | 0.088 | 1.6 |
| hCV11247694 | PALLD | C | A | 762 | 973 | Allelic | 0.006 | 1.2 |
| hCV11247713 | PALLD | A | A | 759 | 967 | Rec | 0.055 | 1.2 |
| hCV323071 | PALLD | A | A | 751 | 963 | Allelic | 0.004 | 1.2 |
| hCV49128 | PALLD | T | A | 651 | 819 | Rec | 0.028 | 1.3 |
| hCV505516 | PALLD | A | A | 758 | 972 | Allelic | 0.056 | 1.2 |
| hDV72090975 | PALLD | C | B | 502 | 460 | Rec | 0.094 | 1.6 |
| hDV72090986 | PALLD | T | A | 763 | 974 | Rec | 0.004 | 1.5 |
| hDV72091004 | PALLD | G | A | 767 | 975 | Allelic | 0.020 | 1.6 |
| hCV11315171 | ROS1 | T | A | 690 | 835 | Allelic | 0.002 | 1.3 |
| hCV11315231 | ROS1 | G | A | 763 | 971 | Allelic | 0.020 | 1.2 |
| hCV2100197 | ROS1 | C | A | 769 | 976 | Dom | 0.055 | 4.0 |
| hCV2100250 | ROS1 | C | A | 763 | 975 | Dom | 0.048 | 1.9 |
| hCV27484788 | ROS1 | A | A | 766 | 974 | Allelic | 0.014 | 1.3 |
| hCV8908863 | ROS1 | C | A | 764 | 971 | Allelic | 0.000 | 1.3 |
| hCV8908875 | ROS1 | A | A | 766 | 970 | Allelic | 0.010 | 1.2 |
| hCV15954965 | SNX19 | A | A | 762 | 976 | Rec | 0.003 | 1.4 |
| hCV25626077 | SNX19 | C | A | 767 | 976 | Rec | 0.009 | 1.3 |
| hCV26490082 | SNX19 | A | A | 765 | 974 | Rec | 0.004 | 1.5 |
| hCV3108768 | SNX19 | T | B | 501 | 461 | Allelic | 0.061 | 1.2 |
| hCV3108811 | SNX19 | T | A | 741 | 970 | Dom | 0.046 | 1.2 |
| hCV31258057 | SNX19 | T | A | 766 | 975 | Allelic | 0.070 | 1.1 |
| hCV1036123 | VAMP8 | C | B | 431 | 498 | Rec | 0.002 | 2.0 |
| hCV2091601 | VAMP8 | G | B | 430 | 498 | Rec | 0.057 | 4.1 |
| hCV2091606 | VAMP8 | G | B | 430 | 498 | Rec | 0.057 | 4.1 |
| hCV2091642 | VAMP8 | A | B | 430 | 495 | Allelic | 0.016 | 1.3 |
| hCV2091643 | VAMP8 | C | B | 429 | 498 | Allelic | 0.019 | 1.3 |
| hCV2091655 | VAMP8 | C | B | 428 | 485 | Dom | 0.065 | 1.3 |
| hCV25935078 | VAMP8 | C | B | 430 | 498 | Rec | 0.010 | 1.9 |
| hCV3225041 | VAMP8 | G | B | 431 | 498 | Rec | 0.011 | 1.8 |
| hCV3225044 | VAMP8 | G | B | 426 | 494 | Rec | 0.014 | 1.8 |

Design Key:
A  Cases with MI vs. controls with no CVD
B  Younger cases with MI (female <60, male <55) vs. Older controls with no CVD (female >70, male >65)

TABLE 8

| SNP Marker Identifier | Gene Symbol | Risk Allele | Sample Set 1 | Mode 2 | P value 1 | OR 1 | OR 1 95% CI | Sample Set 2 | Mode 2 | P value 2 | OR 2 | OR 2 95% CI |
|---|---|---|---|---|---|---|---|---|---|---|---|---|
| hCV3130332 | K6IRS4 | A | CCF | Allelic | 0.04 | 1.32 | 0.98-1.70 | UCSF | Allelic | 0.04 | 1.28 | 0.99-1.63 |
| | | | CCF | Dom | 0.03 | 1.32 | 0.98-1.70 | UCSF | Dom | 0.03 | 1.28 | 0.99-1.63 |
| | | | CCF | Rec | 0.30 | 1.32 | 0.98-1.70 | UCSF | Rec | 0.42 | 1.28 | 0.99-1.63 |

TABLE 9

| Interrogated SNP | Interrogated rs | LD SNP | LD SNP rs | Power | Threshold $r^2$ | $r^2$ |
|---|---|---|---|---|---|---|
| hCV11315168 | rs619203 | hCV11315156 | rs13197910 | 0.7 | 0.605 | 0.71 |
| hCV11315168 | rs619203 | hCV11315160 | rs511764 | 0.7 | 0.605 | 1.00 |
| hCV11315168 | rs619203 | hCV11315160 | rs511764 | 0.8 | 0.769 | 1.00 |
| hCV11315168 | rs619203 | hCV11315167 | rs554017 | 0.7 | 0.605 | 0.71 |
| hCV11315168 | rs619203 | hCV11315170 | rs529156 | 0.7 | 0.605 | 1.00 |
| hCV11315168 | rs619203 | hCV11315170 | rs529156 | 0.8 | 0.769 | 1.00 |
| hCV11315168 | rs619203 | hCV11315171 | rs529038 | 0.7 | 0.605 | 1.00 |
| hCV11315168 | rs619203 | hCV11315171 | rs529038 | 0.8 | 0.769 | 1.00 |
| hCV11315168 | rs619203 | hCV11315172 | rs526306 | 0.7 | 0.605 | 0.71 |
| hCV11315168 | rs619203 | hCV2217381 | rs507280 | 0.7 | 0.605 | 0.63 |
| hCV11315168 | rs619203 | hCV2217382 | rs587575 | 0.7 | 0.605 | 0.63 |
| hCV11315168 | rs619203 | hCV2217394 | rs483223 | 0.7 | 0.605 | 1.00 |
| hCV11315168 | rs619203 | hCV2217394 | rs483223 | 0.8 | 0.769 | 1.00 |

TABLE 9-continued

| Interrogated SNP | Interrogated rs | LD SNP | LD SNP rs | Power | Threshold $r^2$ | $r^2$ |
|---|---|---|---|---|---|---|
| hCV11315168 | rs619203 | hCV850544 | rs485768 | 0.7 | 0.605 | 1.00 |
| hCV11315168 | rs619203 | hCV850544 | rs485768 | 0.8 | 0.769 | 1.00 |
| hCV11315171 | rs529038 | hCV11315156 | rs13197910 | 0.7 | 0.626 | 0.71 |
| hCV11315171 | rs529038 | hCV11315160 | rs511764 | 0.7 | 0.626 | 1.00 |
| hCV11315171 | rs529038 | hCV11315160 | rs511764 | 0.8 | 0.796 | 1.00 |
| hCV11315171 | rs529038 | hCV11315167 | rs554017 | 0.7 | 0.626 | 0.71 |
| hCV11315171 | rs529038 | hCV11315168 | rs619203 | 0.7 | 0.626 | 1.00 |
| hCV11315171 | rs529038 | hCV11315168 | rs619203 | 0.8 | 0.796 | 1.00 |
| hCV11315171 | rs529038 | hCV11315170 | rs529156 | 0.7 | 0.626 | 1.00 |
| hCV11315171 | rs529038 | hCV11315170 | rs529156 | 0.8 | 0.796 | 1.00 |
| hCV11315171 | rs529038 | hCV11315172 | rs526306 | 0.7 | 0.626 | 0.71 |
| hCV11315171 | rs529038 | hCV2217381 | rs507280 | 0.7 | 0.626 | 0.63 |
| hCV11315171 | rs529038 | hCV2217382 | rs587575 | 0.7 | 0.626 | 0.63 |
| hCV11315171 | rs529038 | hCV2217394 | rs483223 | 0.7 | 0.626 | 1.00 |
| hCV11315171 | rs529038 | hCV2217394 | rs483223 | 0.8 | 0.796 | 1.00 |
| hCV11315171 | rs529038 | hCV850544 | rs485768 | 0.7 | 0.626 | 1.00 |
| hCV11315171 | rs529038 | hCV850544 | rs485768 | 0.8 | 0.796 | 1.00 |
| hCV15807798 | rs2486758 | hCV29348349 | rs6584535 | 0.7 | 0.899 | 1.00 |
| hCV15807798 | rs2486758 | hCV30611452 | rs9420881 | 0.7 | 0.899 | 1.00 |
| hCV15954965 | rs2236711 | hCV12036362 | rs1893019 | 0.7 | 0.780 | 0.97 |
| hCV15954965 | rs2236711 | hCV12036363 | rs1893018 | 0.7 | 0.780 | 1.00 |
| hCV15954965 | rs2236711 | hCV12036363 | rs1893018 | 0.8 | 0.992 | 1.00 |
| hCV15954965 | rs2236711 | hCV12036366 | rs1893017 | 0.7 | 0.780 | 1.00 |
| hCV15954965 | rs2236711 | hCV12036366 | rs1893017 | 0.8 | 0.992 | 1.00 |
| hCV15954965 | rs2236711 | hCV15956925 | rs2282579 | 0.7 | 0.780 | 0.93 |
| hCV15954965 | rs2236711 | hCV16140214 | rs2155752 | 0.7 | 0.780 | 1.00 |
| hCV15954965 | rs2236711 | hCV16140214 | rs2155752 | 0.8 | 0.992 | 1.00 |
| hCV15954965 | rs2236711 | hCV16140215 | rs2155751 | 0.7 | 0.780 | 1.00 |
| hCV15954965 | rs2236711 | hCV16140215 | rs2155751 | 0.8 | 0.992 | 1.00 |
| hCV15954965 | rs2236711 | hCV25626063 | rs3751039 | 0.7 | 0.780 | 0.93 |
| hCV15954965 | rs2236711 | hCV26490015 | rs7942621 | 0.7 | 0.780 | 1.00 |
| hCV15954965 | rs2236711 | hCV26490015 | rs7942621 | 0.8 | 0.992 | 1.00 |
| hCV15954965 | rs2236711 | hCV27467549 | rs3190331 | 0.7 | 0.780 | 1.00 |
| hCV15954965 | rs2236711 | hCV27467549 | rs3190331 | 0.8 | 0.992 | 1.00 |
| hCV15954965 | rs2236711 | hCV27497392 | rs3829271 | 0.7 | 0.780 | 0.84 |
| hCV15954965 | rs2236711 | hCV27868998 | rs4936121 | 0.7 | 0.780 | 0.93 |
| hCV15954965 | rs2236711 | hCV27869000 | rs4436551 | 0.7 | 0.780 | 1.00 |
| hCV15954965 | rs2236711 | hCV27869000 | rs4436551 | 0.8 | 0.992 | 1.00 |
| hCV15954965 | rs2236711 | hCV27869001 | rs4264159 | 0.7 | 0.780 | 1.00 |
| hCV15954965 | rs2236711 | hCV27869001 | rs4264159 | 0.8 | 0.992 | 1.00 |
| hCV15954965 | rs2236711 | hCV27931232 | rs4456262 | 0.7 | 0.780 | 1.00 |
| hCV15954965 | rs2236711 | hCV27931232 | rs4456262 | 0.8 | 0.992 | 1.00 |
| hCV15954965 | rs2236711 | hCV27996234 | rs4457753 | 0.7 | 0.780 | 1.00 |
| hCV15954965 | rs2236711 | hCV27996234 | rs4457753 | 0.8 | 0.992 | 1.00 |
| hCV15954965 | rs2236711 | hCV29138820 | rs7119425 | 0.7 | 0.780 | 0.83 |
| hCV15954965 | rs2236711 | hCV29138826 | rs4936123 | 0.7 | 0.780 | 1.00 |
| hCV15954965 | rs2236711 | hCV29138826 | rs4936123 | 0.8 | 0.992 | 1.00 |
| hCV15954965 | rs2236711 | hCV29138827 | rs6590520 | 0.7 | 0.780 | 1.00 |
| hCV15954965 | rs2236711 | hCV29138827 | rs6590520 | 0.8 | 0.992 | 1.00 |
| hCV15954965 | rs2236711 | hCV3108698 | rs1054869 | 0.7 | 0.780 | 1.00 |
| hCV15954965 | rs2236711 | hCV3108698 | rs1054869 | 0.8 | 0.992 | 1.00 |
| hCV15954965 | rs2236711 | hCV3108699 | rs10160281 | 0.7 | 0.780 | 1.00 |
| hCV15954965 | rs2236711 | hCV3108699 | rs10160281 | 0.8 | 0.992 | 1.00 |
| hCV15954965 | rs2236711 | hCV31258081 | rs10791100 | 0.7 | 0.780 | 1.00 |
| hCV15954965 | rs2236711 | hCV31258081 | rs10791100 | 0.8 | 0.992 | 1.00 |
| hCV15954965 | rs2236711 | hCV31258087 | rs10894273 | 0.7 | 0.780 | 1.00 |
| hCV15954965 | rs2236711 | hCV31258087 | rs10894273 | 0.8 | 0.992 | 1.00 |
| hCV15954965 | rs2236711 | hCV31258089 | rs12363140 | 0.7 | 0.780 | 1.00 |
| hCV15954965 | rs2236711 | hCV31258089 | rs12363140 | 0.8 | 0.992 | 1.00 |
| hCV15954965 | rs2236711 | hCV31258092 | rs11222369 | 0.7 | 0.780 | 1.00 |
| hCV15954965 | rs2236711 | hCV31258092 | rs11222369 | 0.8 | 0.992 | 1.00 |
| hCV15954965 | rs2236711 | hCV31258095 | rs12365680 | 0.7 | 0.780 | 0.84 |
| hCV15954965 | rs2236711 | hCV31258101 | rs4459316 | 0.7 | 0.780 | 1.00 |
| hCV15954965 | rs2236711 | hCV31258101 | rs4459316 | 0.8 | 0.992 | 1.00 |
| hCV15954965 | rs2236711 | hCV31258104 | rs10791103 | 0.7 | 0.780 | 1.00 |
| hCV15954965 | rs2236711 | hCV31258104 | rs10791103 | 0.8 | 0.992 | 1.00 |
| hCV15954965 | rs2236711 | hCV31258105 | rs7106973 | 0.7 | 0.780 | 0.96 |
| hCV15954965 | rs2236711 | hCV31258108 | rs7107595 | 0.7 | 0.780 | 1.00 |
| hCV15954965 | rs2236711 | hCV31258108 | rs7107595 | 0.8 | 0.992 | 1.00 |
| hCV15954965 | rs2236711 | hCV7507666 | rs1050078 | 0.7 | 0.780 | 0.84 |
| hCV15954965 | rs2236711 | hDV71141362 | rs876641 | 0.7 | 0.780 | 1.00 |
| hCV15954965 | rs2236711 | hDV71141362 | rs876641 | 0.8 | 0.992 | 1.00 |
| hCV16196618 | rs2307469 | hCV25927064 | rs10202693 | 0.7 | 0.780 | 1.00 |
| hCV16196618 | rs2307469 | hCV25927064 | rs10202693 | 0.8 | 0.992 | 1.00 |
| hCV16196618 | rs2307469 | hCV2787341 | rs10176233 | 0.7 | 0.780 | 1.00 |
| hCV16196618 | rs2307469 | hCV2787341 | rs10176233 | 0.8 | 0.992 | 1.00 |
| hCV16196618 | rs2307469 | hCV2787344 | rs12469391 | 0.7 | 0.780 | 1.00 |

TABLE 9-continued

| Interrogated SNP | Interrogated rs | LD SNP | LD SNP rs | Power | Threshold $r^2$ | $r^2$ |
|---|---|---|---|---|---|---|
| hCV16196618 | rs2307469 | hCV2787344 | rs12469391 | 0.8 | 0.992 | 1.00 |
| hCV16196618 | rs2307469 | hCV2787347 | rs12470942 | 0.7 | 0.780 | 1.00 |
| hCV16196618 | rs2307469 | hCV2787347 | rs12470942 | 0.8 | 0.992 | 1.00 |
| hCV16196618 | rs2307469 | hCV30087629 | rs4648197 | 0.7 | 0.780 | 1.00 |
| hCV16196618 | rs2307469 | hCV30087629 | rs4648197 | 0.8 | 0.992 | 1.00 |
| hCV16196618 | rs2307469 | hCV30177777 | rs9631047 | 0.7 | 0.780 | 1.00 |
| hCV16196618 | rs2307469 | hCV30177777 | rs9631047 | 0.8 | 0.992 | 1.00 |
| hCV16196618 | rs2307469 | hCV31844737 | rs4648203 | 0.7 | 0.780 | 1.00 |
| hCV16196618 | rs2307469 | hCV31844737 | rs4648203 | 0.8 | 0.992 | 1.00 |
| hCV16196618 | rs2307469 | hCV31844752 | rs4648228 | 0.7 | 0.780 | 1.00 |
| hCV16196618 | rs2307469 | hCV31844752 | rs4648228 | 0.8 | 0.992 | 1.00 |
| hCV16196618 | rs2307469 | hCV31844783 | rs13424255 | 0.7 | 0.780 | 1.00 |
| hCV16196618 | rs2307469 | hCV31844783 | rs13424255 | 0.8 | 0.992 | 1.00 |
| hCV16196618 | rs2307469 | hCV31844785 | rs13398178 | 0.7 | 0.780 | 1.00 |
| hCV16196618 | rs2307469 | hCV31844785 | rs13398178 | 0.8 | 0.992 | 1.00 |
| hCV16196618 | rs2307469 | hCV31844790 | rs13426400 | 0.7 | 0.780 | 1.00 |
| hCV16196618 | rs2307469 | hCV31844790 | rs13426400 | 0.8 | 0.992 | 1.00 |
| hCV16196618 | rs2307469 | hCV32378670 | rs4648182 | 0.7 | 0.780 | 1.00 |
| hCV16196618 | rs2307469 | hCV32378670 | rs4648182 | 0.8 | 0.992 | 1.00 |
| hCV1913911 | rs2477037 | hCV11646539 | rs2249547 | 0.7 | 0.749 | 0.96 |
| hCV1913911 | rs2477037 | hCV11646539 | rs2249547 | 0.8 | 0.953 | 0.96 |
| hCV1913911 | rs2477037 | hCV11646540 | rs2249473 | 0.7 | 0.749 | 0.96 |
| hCV1913911 | rs2477037 | hCV11646540 | rs2249473 | 0.8 | 0.953 | 0.96 |
| hCV1913911 | rs2477037 | hCV15931271 | rs2249834 | 0.7 | 0.749 | 0.90 |
| hCV1913911 | rs2477037 | hCV1913874 | rs960875 | 0.7 | 0.749 | 0.84 |
| hCV1913911 | rs2477037 | hCV1913878 | rs2254342 | 0.7 | 0.749 | 0.87 |
| hCV1913911 | rs2477037 | hCV1913893 | rs2243537 | 0.7 | 0.749 | 0.87 |
| hCV1913911 | rs2477037 | hCV1913894 | rs912491 | 0.7 | 0.749 | 0.86 |
| hCV1913911 | rs2477037 | hCV1913897 | rs912488 | 0.7 | 0.749 | 0.97 |
| hCV1913911 | rs2477037 | hCV1913897 | rs912488 | 0.8 | 0.953 | 0.97 |
| hCV1913911 | rs2477037 | hCV1913899 | rs2494983 | 0.7 | 0.749 | 0.90 |
| hCV1913911 | rs2477037 | hCV1913900 | rs2246164 | 0.7 | 0.749 | 0.96 |
| hCV1913911 | rs2477037 | hCV1913900 | rs2246164 | 0.8 | 0.953 | 0.96 |
| hCV1913911 | rs2477037 | hCV3120077 | rs722569 | 0.7 | 0.749 | 0.90 |
| hCV1913911 | rs2477037 | hCV3120083 | rs2249457 | 0.7 | 0.749 | 0.96 |
| hCV1913911 | rs2477037 | hCV3120083 | rs2249457 | 0.8 | 0.953 | 0.96 |
| hCV1913911 | rs2477037 | hCV3120088 | rs2255751 | 0.7 | 0.749 | 0.90 |
| hCV1913911 | rs2477037 | hCV3120090 | rs2477035 | 0.7 | 0.749 | 0.97 |
| hCV1913911 | rs2477037 | hCV3120090 | rs2477035 | 0.8 | 0.953 | 0.97 |
| hCV1913911 | rs2477037 | hCV8881174 | rs1359282 | 0.7 | 0.749 | 0.90 |
| hCV1913911 | rs2477037 | hCV8881179 | rs1007499 | 0.7 | 0.749 | 0.90 |
| hCV1913911 | rs2477037 | hCV8881199 | rs1324314 | 0.7 | 0.749 | 0.90 |
| hCV1913911 | rs2477037 | hDV71123422 | rs2477036 | 0.7 | 0.749 | 0.97 |
| hCV1913911 | rs2477037 | hDV71123422 | rs2477036 | 0.8 | 0.953 | 0.97 |
| hCV202800 | rs3996003 | hCV27977948 | rs4273372 | 0.7 | 0.801 | 0.84 |
| hCV202800 | rs3996003 | hDV71161241 | rs7433826 | 0.7 | 0.801 | 0.81 |
| hCV8908863 | rs1535330 | hCV11315231 | rs3798381 | 0.7 | 0.461 | 0.63 |
| hCV8908863 | rs1535330 | hCV11315231 | rs3798381 | 0.8 | 0.586 | 0.63 |
| hCV8908863 | rs1535330 | hCV15989251 | rs2354341 | 0.7 | 0.461 | 0.52 |
| hCV8908863 | rs1535330 | hCV16176657 | rs2243383 | 0.7 | 0.461 | 0.60 |
| hCV8908863 | rs1535330 | hCV16176657 | rs2243383 | 0.8 | 0.586 | 0.60 |
| hCV8908863 | rs1535330 | hCV2100216 | rs3798385 | 0.7 | 0.461 | 0.58 |
| hCV8908863 | rs1535330 | hCV2100217 | rs3798384 | 0.7 | 0.461 | 0.66 |
| hCV8908863 | rs1535330 | hCV2100217 | rs3798384 | 0.8 | 0.586 | 0.66 |
| hCV8908863 | rs1535330 | hCV2100221 | rs9481704 | 0.7 | 0.461 | 0.58 |
| hCV8908863 | rs1535330 | hCV2100223 | rs9374655 | 0.7 | 0.461 | 1.00 |
| hCV8908863 | rs1535330 | hCV2100223 | rs9374655 | 0.8 | 0.586 | 1.00 |
| hCV8908863 | rs1535330 | hCV2100227 | rs3798383 | 0.7 | 0.461 | 0.63 |
| hCV8908863 | rs1535330 | hCV2100227 | rs3798383 | 0.8 | 0.586 | 0.63 |
| hCV8908863 | rs1535330 | hCV2100230 | rs9320597 | 0.7 | 0.461 | 0.63 |
| hCV8908863 | rs1535330 | hCV2100230 | rs9320597 | 0.8 | 0.586 | 0.63 |
| hCV8908863 | rs1535330 | hCV27424306 | rs9401001 | 0.7 | 0.461 | 0.63 |
| hCV8908863 | rs1535330 | hCV27424306 | rs9401001 | 0.8 | 0.586 | 0.63 |
| hCV8908863 | rs1535330 | hCV30502071 | rs9401000 | 0.7 | 0.461 | 0.63 |
| hCV8908863 | rs1535330 | hCV30502071 | rs9401000 | 0.8 | 0.586 | 0.63 |
| hCV8908863 | rs1535330 | hCV3228481 | rs2243384 | 0.7 | 0.461 | 0.56 |
| hCV8908863 | rs1535330 | hDV71169900 | rs2038497 | 0.7 | 0.461 | 0.62 |
| hCV8908863 | rs1535330 | hDV71169900 | rs2038497 | 0.8 | 0.586 | 0.62 |
| hCV8908875 | rs1321807 | hCV16176657 | rs2243383 | 0.7 | 0.916 | 1.00 |
| hCV8908875 | rs1321807 | hCV2100227 | rs3798383 | 0.7 | 0.916 | 0.97 |
| hCV8908875 | rs1321807 | hCV2100230 | rs9320597 | 0.7 | 0.916 | 0.97 |
| hCV8908875 | rs1321807 | hCV27424306 | rs9401001 | 0.7 | 0.916 | 0.97 |
| hCV8908875 | rs1321807 | hCV30502071 | rs9401000 | 0.7 | 0.916 | 0.97 |
| hCV8908875 | rs1321807 | hDV71169900 | rs2038497 | 0.7 | 0.916 | 0.97 |

SEQUENCE LISTING (783 sequences)

SEQ ID NO: 1 - DNA, 2944 bp, Homo sapien
ggcgctgccatgttggcggaagcggacccccctgtgccgtggaaactggcggtggccgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctcccatga

SEQ ID NO: 2 - DNA, 2016 bp, Homo sapien
gtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaaggtgggagagaccaggggccccgggagggaggcaaatgagcattgagaaattctgggacaggagctcggcgagaaaagaaggggcggaagttcaaatagctgccacttggagggtttctcttagactatggacgctgtctcctctcctttgccgtgaagcagcgcttgatccgccgcctgcttggaggctggtccctttccccgacgcacaccctggcttctcactctggctggggactcccacagagagggcagctctggcaggggcaggggccactgtgggactgggacgaaggagcgactccctagcgtcctgcaaggcaggcgcagcgtctcctattctaggctgcagaacccgagctgagtgtcagtcgggatgtgacatgaagcgtctggcctggtccctcttcctttcaagctttccccgtccctcgtggactcggtccccctgccccacatttcagaaggctccccttccccctccacgtggacacacggcctcctcccctccccccttggtctgtgggtctgcaaggagccctcgcgggaagcaggaaggagcggggtcgcggagcggtggacaagccggcgccgttgctccccgccctctccgtagagctgttccgggcgccggtgctgagggtgatgggtccgcgggaggcccgcggcgcggcgctgggtggggtggtgctgcgctgcgacacgcgcctgcacccgcagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctattt

SEQ ID NO: 3 - DNA, 707 bp, Homo sapien
atggagtgggaaaataggaaaagaggcactgctggaagacagaagataaactgtattttgtggttttgtgtaagcctgccattgccttcatctagacctgccaagtgtgacagatttggacacactggaaaagttaacgttttcagtgggaagttctgggtttcagttccttctgtcagtttaggtatcatcagcatcatcattagaatcactaaggagtcagagaaagctcttgaccttctggacttgatgtacaatttgaatgagaattctcttcctggaaacttcatctaccttactaccttccgtgcactcttatatattaggaagctcacaaagttgcagatacccagctttagggataacaacctgatcttgcagcctagggaaactggggagtttacccagcttaaggaactcaacattcagggcaactgcctgacccttctgctcccagaactaggaaacttatatttaactggtcagaagaaggtatgcaaagtggagaacagcccctgggttaccccaattgctggccagttccagcttgatgtgtcctgtgtgtctgaatgtgtctgttctgagacatatgagtacctctatggcagcacatgcaggcaaatccagaaccaccaaaacataataatcacaaatcagaaaagatgagctggaaacacctgacagacagtaacaaataagaggtgggc

SEQ ID NO: 4 - DNA, 2523 bp, Homo sapien
gcgggaaactcgagttggctcgagcttgccctgaagacgcgccacgccccctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatccgcgtggacaacgtccgcccgcgctgggacttcaccggcgccttctacttcgtgggcaccgtcgtttccaccatagggtttgggatgacaactccggcgacagtaggaggaaaaatctttctgatcttttacggccttgttgggtgttccagcaccatcttgttcttcaacctcttcctggagcgcctgatcaccatcatcgcctacatcatgaagtcgtgccaccagcggcagctccggagacgaggggccctgccccaggagagcctgaaggatgcggggcagtgtgaggtggacagcctggccggctggaagccctccgtgtactacgtcatgctgatcctatgcacagcctccatcctcatctcttgctgcgcctcagccatgtacacccccattgaaggctggagctactttgactcactctacttctgttttgtggctttcagcaccattggctttggggacctggtcagcagccagaacgcccactatgagagccaaggcctctatcgctttgccaacttcgtcttcatcctcatgggtgtctgctgcatctactccttgttcaatgtcatctctatcctcatcaaacagtccttgaactggatcctgaggaaaatggacagcgggtgctgcccgcaatgccagagaggactcttgcgatcacgcaggaacgtggtgatgccaggcagcgtccggaaccgctgcaacatctccatagagacagacggggtggcagagagtgacacggacgggcgccggctctcaggggagatgatctccatgaaggacttgctggcagccaacaaggcctcgttggccatcctgcagaagcaactgtctgagatggccaacggctgcccccaccagaccagcacactggcccgggacaatgaattctcagggggggtgggagcctttgcaatcatgaacaacaggttggcagagaccagtggggacaggtagaagccaggagtggatgctgggcagaggccagagtagaatggaggatgattgccgcccaggggacgagctcagccctgcgccttggctctgttccttctgggagctgttcccgggagcctccgcaagcatctttagaaatctgatctcggctccaaccaacagccaccttccagggatggggggcctgaagcctcgatgcttgtctcctgatccttattctttaagtctaaattcagtcttttcaaaacaaatcacaaaagcagcattagacattgccttgtttcattaatcttgtttcagagctttagctgcctgaggagataggttttccttaagccttgatttcctgaagctctctctgttccttatttgggaacaaaaattgcgaagactcatctttccctagaactctgaatggatgaatttttaaaagtggggagaatgtttggggatgtgtctgggctttctttttgccaggcttccttcaaagcatacctgccaatggtgtctgcatagggaaaatgtctgttgtactctttatacctgtttctgttttttgttgtccctttctttttatttttaaggccttaatgcctggctgtggcgtctgtgagacctcaatgtaataagaaaattaaattcagcttcaggcctttaaactgcagcaagatggtggtgtaggggtgtgggacggggagagactcacttttgtaactaaagaacatagcttaacattttccctttgaatggtcacacagaccatttcatttttaccagggcttggggacccaatgcaaagatgatgactatttaataaaatggaaaatttaataaatcctcattttattaactaa

SEQ ID NO: 5 - DNA, 545 bp, Homo sapien
gggatgtataagacaattgaaatatggtagcatcaaggttgttttgacctaagggcaggatttatggctagtgagggaagtctttcctgccaggagatgttcattgaagtgcagactgctcggagccacaccgcaggctggcagaggaagtgtctcggtgttgccttggcccgttcaccccctgccaggccagtagaggagctgaagagtcttcgccatggtttgagaaaaagcttatagaggcctgaggctggaggcagggggatcagtgaggaggctgcagcatcagtccagcctctctccaagttcgctccagggcttgcgagaaacaaagtgctctccctcagccccagctcctcgcacacccagtggaaagaaaacacttgctgtaattggaaagccccgagaaggttgagagcacttttgttttcttcatctctgcgtccttatttcttggaacactacctggcaaaccatgggtgcaccatgcagcaagttaaggtcgccgaagtagaactgcgtattaagccagtgtctccatccag

SEQ ID NO: 6 - DNA, 933 bp, Homo sapien
atggggggaaatcagacttccatcacagagttcctcctactgggatttcccattggcccaaggattcagatgctcctctttgggctcttctccctgttctacatcttcattctgttggggaacgggacaatcctggggctcatctcactggactccagactccacacccccatgtacttcttcctctcacacctggcggtcgtcgacatcgcctgtgcttgcaacacggtgccccagatgctggtgaacctcctgcatccagccaagcccatctcctttgctggctgcatgacccagatgtttctgtttttgagttttgcacatacagaatgtctcctcctggtggtgatgtcctatgatcggtacgtggccatctgccaccctctccgatattctaccatcatgacctggaaagtctgcatcactttggcattgacttcctggattttaggagtcttattggcccttgtccatctagtgttactgctaccactgtccttctgtggaccccagaaacttaatcactttttctgtgaaattatggctgttctcaaacttgcctgtgcggatacccacattaatgaggtaatggttttggcaggggcagtgtctgtgctggtgggacccttcttttccactgtaatatcttatgttcatattctatgtgccattctaaagatccagtcaggagaggggtgccagaaagccttctccatctgctcctcccacctctgtgtggttggactcttttatggcacagccatcatcatgtatgttgagccccagtatgagagccccaaggagcagaagaaatatctcctgctgtttcacagcctcttcaatcccatgcttaatcccctaatttatagtcttaggaacaaggaagtccaaggtactctaaagaggatgcttgaaaagaagagaacttcatga

SEQ ID NO: 7 - DNA, 2616 bp, Homo sapien
agctctcccgaagccgcgggtctccggccggcggcggcggcggcggcggcggcggcgcagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaagtgatgtacaacc

SEQ ID NO: 8 - DNA, 2433 bp, Homo sapien
cgggtctccggccggcggcggcggcggcggcggcggcggcgcaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaagtgatgtacaacc

SEQ ID NO: 9 - DNA, 2121 bp, Homo sapien
cgggtctccggccggcggcggcggcggcggcggcggcggcgcaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaaagtctcactgtgtcgcccaggctggagtgcagtggcacgatctcggctcactgcaacctctgcctcccaggttcaagtgattctcctgcctctgcttcctgagtagctgggattacaggctggtctcaaactcctggccttgagagattctcctgccttggtcttccaaactgctgggattacaatatccggccctactggaatattttaaagtaaatctcaggtgttacatcattgcacttgtaagtactttaaaatgtatctctagcagataaatctttttaacaaaaccacagcatcattgtcacactcaaaaaattgacaagatttccttaattatcatataatagtctgtattgtttctatctcaaaaatacagttttcttggtt

SEQ ID NO: 10 - DNA, 2793 bp, Homo sapien
cagtttgctcatactttgtgacttgcggtcacagtggcattcagctccacacttggtagaaccacaggcacgacaagcatagaaacatcctaaacaatcttcatcgaggcatcgaggtccatcccaataaaaatcaggagaccctggctatcatagaccttagtcttcgctggtatcactcgtctgtctgaaccagcggttgcatttttttaagccttcttttttctcttttaccagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaagtgatgtacaacc

SEQ ID NO: 11 - DNA, 2294 bp, Homo sapien
agtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaagatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaagcat

SEQ ID NO: 12 - DNA, 2561 bp, Homo sapien
agtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaagcat

SEQ ID NO: 13 - DNA, 5243 bp, Homo sapien
aggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaagcat

SEQ ID NO: 14 - DNA, 924 bp, Homo sapien
atgaatcacagcgttgtaactgagttcattattctgggcctcaccaaaaagcctgaactccagggaattatcttcctcttttttctcattgtctatcttgtggcttttctcggcaacatgctcatcatcattgccaaaatctataacaacaccttgcatacgcccatgtatgttttccttctgacactggctgttgtggacatcatctgcacaacaagcatcataccgaagatgctggggaccatgctaacatcagaaaataccatttcatatgcaggctgcatgtcccagctcttcttgttcacatggtctctgggagctgagatggttctcttcaccaccatggcctatgaccgctatgtggccatttgtttccctcttcattacagtactgttatgaaccaccatatgtgtgtagccttgctcagcatggtcatggctattgcagtcaccaattcctgggtgcacacagctcttatcatgaggttgactttctgtgggccaaacaccattgaccacttcttctgtgagatacccccattgctggctttgtcctgtagccctgtaagaatcaatgaggtgatggtgtatgttgctgatattaccctggccataggggactttattcttacctgcatctcctatggttttatcattgttgctattctccgtatccgcacagtagaaggcaagaggaaggccttctcaacatgctcatctcatctcacagtggtgaccctttactattctcctgtaatctacacctatatccgccctgcttccagctatacatttgaaagagacaaggtggtagctgcactctatactcttgtgactcccacattaaacccgatggtgtacagcttccagaatagggagatgcaggcaggaattaggaaggtgtttgcatttctgaaacactag

SEQ ID NO: 15 - DNA, 2542 bp, Homo sapien
agtttacggaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgtagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatcctgttctcagaaatcaggtctcattaaacatcaaagaattcacacaggagagaaaccctttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatacactgagagaacatgtataaggctgagatagcctgataaactcatcctattaaaatgtatgctgtgatacacaggcaaatttgatgttaacctaagcacatacacagcaattgctcgactgtgtcaattaaatgagtaaaggaagcccaagtacttttaagtggaggaaatgaagtactgtgaatttttaaaacagatgagataattggtgtcgggagtgttgcagtgactgaaaagcttcataaggggcagttggtgggaaagggctaatactgtaatggtggaatgtgggacacatatgtgtcaattcagtttccttagaccagtgccagtgtggaggattaattgaaaaccaggaccataaactttcagaactttgtattatgcagagggatctgtgaaactagtcaatttgtttcattaaacaaatattttaaaattatttcctttgtaccttgtcctgttccaggagctgaggtcaaagaagaaaaagtttgtggtctcctggagagtttgtggggttaattttaagtggtatcattacactcaggcaatctagtcaggcggtgcaaatatctacattaggtgaaatggacatggagtaactgtgtccaggggacgcgataatttattgttcaaggagtag

SEQ ID NO: 16 - DNA, 2488 bp, Homo sapien
gttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgtagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatcctgttctcagaaatcaggtctcattaaacatcaaagaattcacacaggagagaaaccctttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatacactgagagaacatgtataaggctgagatagcctgataaactcatcctattaaaatgtatgctgtgatacacaggcaaatttgatgttaacctaagcacatacacagcaattgctcgactgtgtcaattaaatgagtaaaggaagcccaagtacttttaagtggaggaaatgaagtactgtgaatttttaaaacagatgagataattggtgtcgggagtgttgcagtgactgaaaagcttcataaggggcagttggtgggaaagggctaatactgtaatggtggaatgtgggacacatatgtgtcaattcagtttccttagaccagtgccagtgtggaggattaattgaaaaccaggaccataaactttcagaactttgtattatgcagagggatctgtgaaactagtcaatttgtttcattaaacaaatattttaaaattatttcctttgtaccttgtcctgttccaggagctgaggtcaaagaagaaaaagtttgtggtctcctggagagtttgtggggttaattttaagtggtatcattacactcaggcaatctagtcaggcggtgcaaatatctacattaggtgaaatggacatggagtaactgtgtccaggggacgcgataatttattgttcaaggagtag

SEQ ID NO: 17 - DNA, 1866 bp, Homo sapien
atggtaaaactacaaaggaaacagattgaagatcaagatagtagttccctgggggctggggtaggagtggagaaagcaggggtggatgggaaaggagccacaggattgggagggccctgctcatgctcttctgaagcaggcgatggcctcgcagaagaagaagaagagcaggtgcccactgatggaggcacatcagcagaagccatgcaggttcccttggaagaagatgatgaattggaggaggaagaaattattaatgatgagaatttcctgggcaagagaccactggatagtcctgaagctgaagaactgccagccatgaagcggcctcggctattaagcactaaaggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaactagctctccaggacagaagactaaatcacctaaaaccgcccagtcaccagcaatggtcggaagtcctattcgatcaccaaaaactgtatccaaagaaaagaaatcacctggacgttccaagagccccaagagtcccaagagccccaaggtcacgactcacattccccaaacacctgtgagacctgaaacgcccaacaggactccttcagctacactcagtgaaaaaatcagtaaagagactatccaggtaaaacaaatacagacaccccctgatgctgggaaactgaacagtgagaatcagccgaaaaaggctgtggtagcagataaaacgattgaggcctctatcgatgctgtgattgcacgagcctgtgctgagcgagagccagatcctttcgaattttcttctggatcggaatctgaaggagacatttttactagccctaagagaatttcaggcccggagtgtactactcccaaagcttccacttccgcgaacaatttcacaaagtcaggatccactcctctgcctctttccggtggaacctcaagttccgataactcatggacaatggatgcctccattgatgaggttgtacgtaaagcaaaactgggaacaccttcaaatatgccccccaactttccttatatctcttctccgtcagtgtctcctcccactcccgaacctctccacaaggtgtatgaggagaaaaccaagctgccttcctccgtggagataaaagtggaaccagtcgctctggccccgagtccagttatccccagattaactctccgagtcggtgctggccaagacaagatactcttggtggcaagtaacagaaatccaaatcaaaccgtcttagaggggaaaacagcaggggtggatgtgacttcggcggggccacctgcaggcttgccaagtatcctagggctctgcccaccctcctcttctcatctggcctctgcggtggcagaggtggtcctggccactcaggctgttgtgattcttggtgctcacagtccctggcgaagccccgcttcccgggcctccgttatcagcccccgtgaaggacttcgcttcagcagcccctgtggtagggaggctgccctgtcagaaggggaagtgtgtggagcacaggctgctccaggtcctctccagctggagccacagtggaaggagcagcccctgtcaggcccccccgaggactcagcagaggtgggggtggggagcgccacctctgaagccgtcagagcttctgccccagcacaggaacaggcaattgaagtcatatttctg

SEQ ID NO: 18 - DNA, 3394 bp, Homo sapien
ccgccgccggtatccgcgtccgcagcgccgccagccaggcgagagccgtgtgggatcccagcgcccgcactcccgcccccgccaaggagccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaaca

SEQ ID NO: 19 - DNA, 3465 bp, Homo sapien
gctgggagacgcctgggcgccgggggctgcaggtcccagggcgggggctgcgtccgtcaccggcaggtacccaggtatgccgcagagccaggcacgccgtgggcactcagtcagtatctgtggaatgaatgaatgatggtcgtccctgggagcttatctctgaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaaca

SEQ ID NO: 20 - DNA, 3410 bp, Homo sapien
actcccgcccccgccaaggagccaggtgagccgctgctgggagacgcctgggcgccgggggctgcaggtcccagggcgggggctgcgtccgtcaccggcaggtacccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaaca

SEQ ID NO: 21 - DNA, 7074 bp, Homo sapien
catttctacttcatatgatcattttaattgtatttacctcatcttaccaaaaagatcatggttgaatcttgcctactcacgtttagggcctttttttggtggattgctttaataaagatggatctgtcagaccttggagaagccgcagccttcctcagaagaagtgaagctgagctgcttctactacaggccacagccttggatgggaagaagaaatgctggattcctgatggtgagaatgcttatatcgaggctgaggtaaaagggagtgaagatgatggaacagtaattgttgagacagcagatggagagagtctgagcataaaggaggacaaaatccagcagatgaatcctccagagtttgaaatgattgaagacatggcaatgctgactcacctcaatgaggcatccgtgctgcataccctgaagcggcgctatggccagtggatgatctatacatattcaggtctcttctgtgtgaccataaacccttacaaatggcttcccgtgtatcagaaagaagtcatggccgcctacaaagggaagaggcgatcagaggctccccctcacatctttgctgttgccaataacgcctttcaggacatgcttcacaatcgagaaaatcagtctatactcttcacaggagaatctggtgctggaaagactgtgaacagcaaacatattatccagtattttgccaccatagcagccatgattgaatccaggaaaaagcagggggcgttagaagatcaaatcatgcaagcgaatactatcttggaagcatttggaaatgctaaaaccctgagaaatgacaactcctctcgttttggcaaattcatcaggatgcactttggtgccagaggcatgctgtcatctgtggacattgatatctatttgcttgaaaagtccagggtgattttccagcaggctggagagaggaactaccacatattctatcaaattctatctggacaaaaagagcttcatgacctgctcctggtatctgcaaatccctcagacttccacttttgctcctgtggagcagttactgtggagagcttggatgatgctgaagaattgctggccacagaacaagccatggacatcttgggctttcttcctgatgagaagtatggatgctataaactcactggagccatcatgcactttggaaatatgaaatttaaacagaaacctagagaagagcaactggaagcagatggcacagaaaatgctgacaaagctgctttcctcatgggcattaactcctctgagttggtaaagtgcttgatccatcctagaatcaaagttggtaacgaatatgttaccagaggtcaaactatagaacaggtaacctgtgctgtcggtgccctgtccaagtcaatgtatgaaaggatgtttaagtggctagtggcacggatcaacagggccctggatgccaagctgtcaaggcagttcttcattggcattcttgacatcactggttttgaaatccttgagtataatagccttgagcaactttgcattaattttaccaatgaaaaattacaacaattcttcaattggcacatgtttgttctggagcaagaggaatataagaaagaaagcattgaatgggtgtctattggctttggtctggatttgcaagcttgcatagatctcattgagaagccaatgggcatcctttccatccttgaagaagagtgtatgtttcctaaggctacagacctgactttcaagaccaaactctttgacaaccattttggaaagtcggttcatctccagaagcccaagcctgataagaagaaatttgaagctcattttgaacttgtccattatgcaggagtggtaccttataatatcagtggttggctggaaaagaacaaagacctccttaatgaaacagtggtagctgtatttcagaagtcttccaacagactcctggcgagcctttttgaaaattacatgagtactgacagtgctataccatttggggagaagaaacgaaagaaaggagcttcattccaaacggttgcatctctgcataaagaaaacctgaataaattgatgactaatctgaaatcaacagcacctcattttgtgagatgcataaatcccaatgtgaacaaaataccaggtatactggacccttacttggttctacagcagttgcgctgtaatggtgtcttggaagggactaggatatgccgtgaaggttttccaaaccgactgcagtatgctgattttaaacaaaggtactgcattctgaatccaaggacctttccaaagagcaagtttgtgagcagcagaaaagcagctgaagaattacttggctccttggagatagaccatacccagtaccgatttggaatcactaaggtgttttttaaagctgggtttctgggccaactggaagcaataagagatgagagactatctaaagtcttcacattgttccaagccagagcacagggcaaactgatgcgaatcaaattccagaagattctggaagaaagggatgcacttattttgatccaatggaacataagagctttcatggctgtgaagaactggccctggatgaggctcttcttcaagatcaagcctcttgttaaatcttcagaagtaggagaagaagtagctggactgaaggaagagtgtgcacaattacagaaagccttggagaaatcagagtttcagagggaggaactgaaagcaaagcaagtatccctcactcaggaaaaaaatgacctgattcttcagcttcaggctgagcaagagacactggcaaatgttgaagagcagtgcgagtggctgattaaatccaagatccagctggaggccagagtaaaggagctgtcggagagggtggaggaagaagaggagataaattctgagctgactgccagggggcggaaactcgaagatgaatgttttgagttgaagaaagaaatcgatgacctggaaacaatgttggtgaagtcagagaaggagaagcgtactacagagcacaaggtcaagaacttgactgaggaagtagagtttctaaatgaggatatcagcaaacttaacagagcagccaaggttgtgcaggaggcccatcagcagaccctggatgacctgcacatggaggaggagaagctcagcagcctgagcaaagcaaatctgaagctggaacagcaagttgatgagcttgagggtgcccttgagcaggagagaaaagcgagaatgaactgtgaaagggaactgcacaaactggagggcaatttaaagctgaatcgggaaagtatggagaacctggaaagcagccagcgacacctggcagaagagctgaggaaaaaagaattagaattgagtcagatgaattcaaaagtggagaatgagaaaggcctggtagctcagcttcagaagacggttaaagagcttcagactcaaataaaggatttgaaagagaaactagaagctgaaaggaccactcgagccaagatggaaagggagagagctgacctcacccaagacctggctgacttgaatgagaggctggaggaggtaggaggatccagtttggctcagctggaaataactaagaaacaggaaaccaaattccagaagctgcaccgagacatggaagaggccactctgcactttgagacaacttctgcatctttgaagaagagacatgcagacagcctggctgagctcgagggccaggtagaaaatctacagcaggtcaagcagaaactggaaaaagacaagagtgacttgcagctagaagtagatgacctcctgacccgtgttgagcagatgacaagagctaaggcaaatgctgagaaactctgtactctatatgaagagcgcttgcatgaagcaactgcaaagctagataaggtgactcagttggcaaatgacctggcagcacaaaagacaaagctgtggagtgagagtggcgagttcctacggaggcttgaagagaaggaggctctgataaaccaactttccagggaaaagagcaacttcactcggcagattgaagacctgagagggcagctggaaaaggagaccaaatcccagagtgccctggcccatgccctgcagaaggctcagcgtgactgtgaccttctacgagagcagtatgaggaagaacaagaggtcaaggctgagctgcaccggaccttatccaaagtcaatgctgaaatggtgcaatggagaatgaagtatgaaaacaatgtcatccagagaacagaagacttggaggatgccaagaaggaactggcaattagattgcaggaggcagccgaagccatgggggtggccaatgccagaaatgcctccttggagagagccaggcaccagctgcagctggagctcggggacgccctgtctgacctcgggaaggtccgctctgcagcagccaggctggaccagaagcagctgcagtctggcaaggcccttgccgactggaagcagaagcacgaggagtcccaggcgttgctggatgcctctcagaaggaagttcaggctctcagtacagagctcctcaagctcaagaacacctatgaggagagcatcgtgggccaggagacactcaggagggagaacaagaacctccaagaagagatttctaatctgacaaaccaggttagagaagggaccaagaacttaactgaaatggaaaaggtcaagaaactaattgaagaagagaagacagaagtccaggtgacactggaagaaacagagggagccctggaacgtaatgaaagcaagattcttcatttccagcttgaactcttggaagctaaagcagaacttgaaagaaagctttcagagaaagatgaagaaatagaaaattttaggaggaagcagcagtgtaccattgactccctgcagtctagtctggattctgaagctaagagcagaattgaggttacccggctgaagaagaagatggaagaggacctcaatgagatggaactccagcttagctgtgccaaccggcaggtgtcagaagcaaccaaatccctgggccagcttcagattcaaatcaaggaccttcaaatgcagctggatgacagcacacaactgaacagtgatctgaaggagcaggtggctgtggctgagcggcgcaactctcttcttcagtctgaactagaggatctaaggtccctgcaagagcagacagagcgtggccgcaggctgtcagaagaagagctcctggaagcaacagaaagaatcaatcttttctatacccagaacacaagcctcctcagccagaagaagaaactggaggctgatgttgcccggatgcagaaagaagctgaagaggtggtgcaggagtgtcaaaatgcagaagagaaggccaagaaggcagccattgaggcagcaaacttgtcagaagaactgaagaagaagcaagacaccattgcccacttggaaaggacaagagaaaatatggagcagacaattacagacttacagaaaaggctggctgaagctgaacagatggccctgatggggagtagaaagcaaatccagaaactagaatccagggttcgtgaactggaaggtgaactggagggtgaaatccgtcgcagtgcagaggcccagaggggagcccgcagacttgagcgatgcatcaaagagctgacctatcaggcagaggaagacaagaagaatctgagcaggatgcaaactcagatggataaacttcagctaaaagtgcaaaattacaagcagcaagtcgaggtggcggaaacacaagccaatcaatacctttccaagtataagaaacagcaacatgagttgaatgaagtgaaggaaagggcagaggtggcagaatctcaagtcaataaactcaaaattaaagcaagagagtttgggaaaaaggttcaagaagaatagcatcccctgctttgaaaggacaacagctggagaagtacaaggaaggtgctgtttcatggccaaaaacttaggttgcatggaaacatttttaaaaacatgtttaaattgcttttcacaccatataaacaaggcaattagaaaaataattaaagggaatatcattgcttccacagttaatggggattttttgatcctcaaatgcaagtaaactaccttctaatgcttcacatgacagattaaataaatggaagaaccttttcaattctgatgtttaaaaaatgaataaatacttgatcctttgtccatatttcctcttaatgggtaggactcatagaagatgtccttagaccagtcacgcttcatggggactagggcatgttggtgaatggtttttactaaagttaggcaactttggcttgattcacccctaaatctatgaatgtatattgtgagccagcagtggtagaatggaagtcataagatctcctcagcattgtgatataaatatagctatagttaggcaatttgaacatgtaggcaaaactctcctaatcaacacacatgtaggctatatgctggtacatgctttaaacatggaggtaaccccacacgagacattcagtgacaggtaatatgctggatttgtgcagtaccgatttggctcagctggaggaacatgtcccggaattcctctctctcatggttctggattggagtaggtcataaagaaatttgcattaatttgatcagcagctattttatactcataaggtcagtgtacagacccaagcatggtgacagcttgaaaatatgactccaggccaaaaaggggagctagaagagaccagagacagctccctggacccagagctcttccagctcctgccagcctcctccttcagctttgcaaagtactggccaggtgtgtgtgcagctccatggcaaccagcatcagcttttcctgagatcacacacagcattgcagtggaggccgtgagacagacatgggttctgtttgttcttatggacttcccttcatccttgctgcattcacagtcgacctacagtgacttcaggcccagaaccagatgcagagggaacagcctggcctagacttctccaccagcacccacaattgtgtaaggctgaagctctataataaatctttattctgtc

SEQ ID NO: 22 - DNA, 7374 bp, Homo sapien
ctgttacaagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagaccttccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgagggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcgcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcagaaccaacttcagttattcagaaattttttcttaaatagcatttatcagtgcagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaatagcgttgtttgggaaatagagagttgagataaacactctcattcagtagttactgaaagaaaactctgctagaatgataaatgtcatggtggtctataactccaaataaacaatgcaacgttcc

SEQ ID NO: 23 - DNA, 6985 bp, Homo sapien
ctgttacaagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagaccttccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgagggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcgcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcagaaccaacttcagttattcagaaattttttcttaaatagcatttatcagtgcagagatgaagcaaacaacagtggagtcataaatgaaagctttgaaggtaagtttgattcttcagaattttctagttttcgctgcactgtgaac

SEQ ID NO: 24 - DNA, 5815 bp, Homo sapien
tactgtctcagtgctgctatatttaagacggtgcagtctccgggatcgcattcttctcccggtgcccgctgagccgagggcaagaagagaacaaggaccctctcggcctcaggaatcttctccccagagactcctaagtgggcacactgcttctgttgttgctctcgtaaccatgactctgccgcacagcttgggaggtgcgggggacccccggcccccccaggccatggaggttcacaggctggagcaccggcaggaggaggagcagaaggaggagcggcagcacagcctgcgcatgggctcctctgtgcggaggcggaccttccgcagcagcgaagaagagcatgagttcagcgccgcggactacgccctggcagcagccctggctctgacggcctcctccgagctgtcttgggaagcccagctgagacgccagacctctgccgtggagctggaggagcgagggcagaagcgggtgggcttcggcaatgactgggagaggactgagatcgccttcctgcagacccaccggctgctgcgccagaggcgggactggaagacgctgaggcggcggacagaggagaaggtccaggaggccaaggagctgagggagctgtgctacggccgcgggccctggttctggatccctcttcgctcccacgccgtctgggagcacaccacggtcctgctgacctgcactgtccaggcctcaccaccaccccaggtcacctggtacaaaaatgacacacggattgatccccgcctctttcgtgccggaaaataccgaatcaccaacaactacgggctgctgtccctggagattaggagatgcgccattgaggactcagcaacttacactgtgcgagtgaagaacgcccacggccaggcctcctccttcgccaaagtcctcgtccgcacttacctggggaaggatgctggcttcgattcagagatcttcaaaagatcgacgtttggccccagcgtggaattcacctcggtgctgaagccagtctttgctcgtgagaaggaacccttctccctgtcatgcttgttttcggaagatgtgttagatgctgagagcatccagtggttccgagatgggagcctactgaggtcctcgagacgtcggaagatcctctacacagaccgccaggcatccctgaaggtgtcctgcacctacaaggaggacgaggggctctacatggtccgggtgccctcgcccttcggaccccgggaacagagcacctacgtgcttgtgagagatgccgaggccgagaaccccggggccccaggctccccactgaacgtccgatgcctggatgtgaacagagactgcctcatcctgacttgggccccgcccagtgacacccggggcaaccccatcactgcctacaccattgagcggtgccagggcgagtctggggaatggatcgcctgccatgaggcccccggagggacttgtcggtgcccaatccaaggcctcgtcgaaggtcagagctatcggttccgggtgagagccatcagcagggtaggcagcagcgtcccctccaaggcctcagagttggttgtcatgggtgaccatgatgcagcccggaggaagacagagatcccctttgatctgggaaacaagatcaccatcagcacagacgcttttgaagatactgtgaccatcccctcaccgccaaccaatgtccatgccagcgagatccgagaggcctatgtggttctggcctgggaggagcccagcccccggggcagagcaccactgacgtactccctggagaagtcagtcataggtagtggcacctgggaggccatcagctcggaaagccctgtgagatccccgagattcgccgttctggacctggagaaaaagaagtcgtatgtcttcagagtgcgagcaatgaaccagtatggcctgagcgatccctcggagcccagcgagcccatcgccttgcggggcccgccagctaccctccctcctccagctcaagttcaagctttcagagacacacagacctctgtctccctgacatgggatcctgtgaaagacccagagctcctgggttattacatctactcccggaaggtggggacatctgagtggcaaacagttaacaacaaacccatccaaggcaccaggtttacagttcccaggctgaggacggggaaggagtacgagttttgtgtcaggtcagtcagcgaggctggggtaggcgagagctcagccgccaccgagcccatcagggtcaagcaggctctggctaccccgtctgccccatatggctttgccctcctgaactgcgggaagaatgaaatggtcattgggtggaaaccccccaagcgtcgtggaggtggcaagatcctgggctacttcctggaccagcatgactcggaagagctggactggcatgcggtcaatcagcagcccatccccacccgggtctgcaaggtcagtgaccttcatgaaggccacttctatgagttccgtgcccgggctgccaactgggcaggtgttggcgagctgtcggcacccagcagcctgtttgagtgcaaagagtggacaatgccccagccaggccccccgtacgatgtacgggcatccgaggtgcgggctacatccctggtgctgcagtgggaacccccactgtatatgggggctgggcctgtcacaggctatcacgtcagtttccaggaggaaggctctgagcagtggaagccggtcaccccaggccccatctctggcacccacctgagggtttccgacttgcagccaggaaagagttacgtgttccaggtacaggccatgaattcagctggtctggggcaaccgtccatgcccactgatcccgtgctcctggaggacaagccaggtgcccatgagatcgaggttggtgtggatgaagagggctttatctatttggcttttgaagcccctgaagcccccgactcctcagagtttcagtggtccaaagactacaagggcccactggacccccagagggtcaagatcgaggataaagttaacaagtccaaggtcatcctgaaagaacccggcctcgaggatttgggcacctactcagtcatagtcactgatgccgatgaagacatctccgcaagccacacgctaaccgaggaagagctggagaagctgaagaagctgagtcatgagatcagaaacccagtgatcaaactgatctccggctggaacattgacatcctggagcgaggggaggtgcggctttggctggaagtagaaaagttatctccagccgctgagctacatctaatcttcaacaacaaggagatcttcagctcgccgaaccgcaaaatcaattttgaccgagagaagggcctggtggaagtgatcatccagaacttgtctgaggaggacaaagggtcgtacaccgctcaactccaagatggaaaagccaaaaaccagattaccttgacactggtggatgacgattttgacaagcttctgaggaaggcagatgctaagagaagggactggaagagaaaacagggtccctattttgagcggccgttgcagtggaaggtcacggaggactgccaagtgcagctgacgtgcaaggtgaccaacaccaagaaggagactcgctttcagtggttcttccagagggcagagatgccagatggtcagtatgacccagagacgggaacgggacttctctgcattgaagagttgtccaaaaaggacaagggaatttacagagcgatggtttctgacgatcgaggggaggacgacaccatattggacctcacgggtgacgccctggatgccatcttcaccgagttgggcaggattggtgccctctctgcaactccactgaaaatccaggggaccgaggaagggatccggatcttcagcaaggtcaagtactacaacgtggagtacatgaaaaccacctggttccacaaagacaaacgtctggagagtggtgatcggataaggacgggcaccaccctggatgagatctggcttcacatcctggaccccaaagactcagacaagggcaaatacactctggaaatagctgcagggaaggaagtccggcagctctcaacagatctctcagggcaagcttttgaggatgcaatggctgaacaccagagactgaaaaccttggccatcatcgagaagaatcgtgccaaagtggtgagaggtctgccggatgtggccactatcatggaagataagaccctgtgcttgacttgcatcgtctcaggagaccccacccctgaaatctcttggctgaagaatgaccagcctgtcaccttccttgaccgataccgcatggaagtgagggggacagaggtcaccatcaccattgagaaggtcaacagtgaagacagcggccgctacggcgtcttcgtcaagaacaagtatggctccgagacgggccaggtcaccatcagtgtgttcaagcacggggacgagcccaaggagctgaagagcatgtgacagcgtgtgtccaggcacagtctgagtctagtctgcatggaccagtagggacaacctgtaccagggtcacagcctggcacaggctacaggggtggggcagaaggaaaggggacaagatagaacccaggatgtgagggtgggggtggagcggatgcaccaaagtggagaagcaaagatctttctggggtcctgagtggcttccaggagagcgggatgaaccctggacctggagtaggagacccggatgcactggggctatctaacagtactggcatctgataggtagaggtcaggtacgctgctaaacactgcagctcccaccacatagaattatccgaccccagatgtcaaaagtgccaagggccatgagccctgccataaactgatacatcgcacccctcttttaggatcccatagtttcaattcatgtaagttcaacagacacctgaagtctagcatgtgggaggctgaggatggagctgggaacacaaaggcagctgataagcaggttctgcttgcaaagaggcctcagtccagtgggagaaacagacctgggcgcaaacaactccaggacaaggcaggacatgataaagattataaagcaggtccaaggaaagtgccgccagtggtccaaggagggagacagagggtcgtcccaacagggggaggtagggctttgaaaacaccttcatccaggctgggcgaggtggctcacgcctgtaatcccagtagtttgggaggccaaggcgggcagatcacctgaggtcaggagttttagaccagcctggccaacatgacgaaacccggtctctactaaaaatacaaaaattagccaggcgtggtggcaggtgcctgtaatcccggctattcagaaggccgaggtgggagaatccgttgaacctgggaggcggaggttgtgatgagccaagattgagccaaaaaaaaattagcagaattggtgttgggccctgaaaaattagtccgattttgtggtggtaatgggagaaggacatcccaggagcagggtctggtgggaggaaagggaaggaggaggctaaggctgcccaggaggccttggataccaggcttggagctggtaacctccagggcttccagcacggggcctctgcctggtgtgacagataccggctggcctcacttgatggatctcagtactgagctgggcatttctctgccccccaacttttttctttttaaaaataagatggggagtgttcataaaattatagatgtttgttgtaaaattttggaaaaccctggaaattatagagaaaataaacataatctatactcccaacaccacaaagt

SEQ ID NO: 25 - DNA, 3985 bp, Homo sapien
cgcgcccgggctcctgcaggcggggcgctgtgcgcgccgcgatccggtacgtgggcctccgggctgtcccctctgggggcggcgatcctccctccggagccccccttcaaccctcccggaagtgaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatgaccttcacctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccagcctttgatgtctttcaaagcttctgtggtgcgccctggattgagaaccaccacccgaggggtacagcccctctcttccaaccgagaagttcctgtcccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggt

SEQ ID NO: 26 - DNA, 3733 bp, Homo sapien
cgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctggctgcggcccccagacctggcgcagcgtgtccagctgtgggagcacttccagagcctgctgtggacctacagccgcctgcgggagcaggagcagtgcttcgccgtggaggtgactactgggcgcgggagtcctcaggacttgaagctgtcagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatgaccttcacctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccagcctttgatgtctttcaaagcttctgtggtgcgccctggattgagaaccaccacccgaggggtacagcccctctcttccaaccgagaagttcctgtcccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggt

SEQ ID NO: 27 - DNA, 2914 bp, Homo sapien
cggaagcgcgcccgggctcctgcaggcggggcgctgtgcgcgccgcgatccggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatgaccttcacctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagccca

SEQ ID NO: 28 - DNA, 3983 bp, Homo sapien
cgcgcccgggctcctgcaggcggggcgctgtgcgcgccgcgatccggtacgtgggcctccgggctgtcccctctgggggcggcgatcctccctccggagccccccttcaaccctcccggaagtgaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatgcttcacctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccagcctttgatgtctttcaaagcttctgtggtgcgccctggattgagaaccaccacccgaggggtacagcccctctcttccaaccgagaagttcctgtcccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggt

SEQ ID NO: 29 - DNA, 1527 bp, Homo sapien
cggaagcgcgcccgggctcctgcaggcggggcgctgtgcgcgccgcgatccggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtgaggaccggaggaaagcaggaggaaacaatagctagctgcgagcgacaggcagcccaggacatctgtcttaggctccagtggacccccgtgcctcctaaggcttgagtgcaggtacccgtgttcctagagcacaggacgctgtctgcggctccccatcttccctgccagctccagcctgaactcaaggactgttaagaccactccactgatccctaaagctgttgatgacaagttgattcatttaaaacttctgtacatgcattctcagactcatcttttttgtaattaaaattaaaaattaagttaaatttagtaataatcatctaatttctatacattctaaaatatattcagcatctgtagtttatactttgtttctccaaagtatgtgggtaaacaataaaaaaaaactataaatattcaaaatggt

SEQ ID NO: 30 - DNA, 2974 bp, Homo sapien
cggaagcgcgcccgggctcctgcaggcggggcgctgtgcgcgccgcgatccggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatgaccttcacctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagccca

SEQ ID NO: 31 - DNA, 3912 bp, Homo sapien
cgcgcccgggctcctgcaggcggggcgctgtgcgcgccgcgatccgcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatgcttcacctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccagcctttgatgtctttcaaagcttctgtggtgcgccctggattgagaaccaccacccgaggggtacagcccctctcttccaaccgagaagttcctgtcccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcagatcttagcagagatgctcacatgcggggtaactgtccatggtgtgtggaggggtcctcggaaccccctcttaggatcatctccacatactctcccagttctgagattcgttaccaatagcaggtttccgtcacactgcgatatcagagcagtgcaggaactctccgctccaaggggttttttcctcctaggggaacactctgctaagtaatgggcagagaacaaaggggctcctaattcaaggcaggcctaagggagggtcagaaagaactttagctggaggt

SEQ ID NO: 32 - DNA, 578 bp, Homo sapien
cgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccaggtccaattccggaccccaggctggcctctgaaggctcttgctggccgtggctggcctgaggacgcttctcctggccaggagccctccaagggtgctggacatgggtgggcctgaatgctctttgccgagatgaactggacctgtcaaagacaccttcatgc

SEQ ID NO: 33 - DNA, 2774 bp, Homo sapien
ctatgctagtggatgtgaagtggtatctcattatggttttggttttcatactcctcatgtttaaggatgctgaacttcttttcatatgcttattggccatttgtgtatatatcttcttttagagaaatgtctatttaagtcctttgacccatttctgtgtccttacccctggtgaggtctcccttattctgttgcttggctggtccctatcctgccaatagtaatgggcccttcttcaccctgatgatggccctgttggcctgtcagcaatccctgggacctcttcttgggtgtgaattcctgggtaacatttctaatgaagtcaaccattcccaccaagtggaattcttagttaactggcatttctctactttcaggttcttggcatggagtagagggtgagggggcccatcccaagcagaatgtttctgtagaagtgttacaggtcaggatccctaatgcagatccttccaccaagaaagctaactcctgtgacatgtgtgggccattcttgaaagacattttgcacctggctgagcatcagggaacacagtctgaggagaaaccctacacatgtggagcatgtgggagagacttttggttgaatgcaaaccttcaccagcaccagaaggagcacagtggagggaagccctttagatggtacaaggacagggacgcacttatgaagagctctaaagtccacctgtcagagaaccccttcacttgcagggaaggtgggaaggtcatcctgggcagctgtgacctcctccagcttcaagctgttgacagtgggcagaagccatattccaatcttgggcagcttccagaagtctgtaccacacagaaactcttcgagtgcagcaactgtggaaaagccttcctgaagagctccactctccccaaccatctgagaactcactctgaagagataccatttacatgcccaacaggtggaaatttcttagaggagaaatcaatccttggtaataaaaaatttcacactggggaaataccccatgtgtgtaaggagtgtgggaaggcctttagtcactcatctaagctgaggaagcaccagaaatttcacactgaagtaaaatattatgagtgcattgcatgtgggaaaaccttcaaccacaaactcacatttgttcatcatcagagaattcactcaggagaaagaccttatgagtgtgatgaatgtgggaaagccttcagtaacagatcacacctcattcggcatgagaaagttcacactggagaaaggccttttgagtgcctgaaatgtggaagagccttcagccaaagctccaatttccttcggcatcagaaagttcacacacaggtaagaccttatgagtgcagtcaatgtggtaaatccttcagccgaagctctgctctcattcagcactggagagttcacactggagaaagaccgtatgaatgcagtgaatgtggaagagcttttaacaataactccaaccttgctcagcaccagaaagttcacaccggagaacggccttttgagtgcagtgaatgtggaagagacttcagccaaagctcccatctccttcgacatcagaaagttcacactggagaacggccttttgaatgctgtgattgtggtaaagccttcagtaatagctccaccctcatccagcaccagaaagtacatactgggcaaaggccttatgagtgcagcgaatgtaggaaatccttcagccgcagctccagcctgattcagcactggagaattcacactggagaaaagccttacgagtgtagtgagtgtgggaaagcctttgctcacagctccactctcattgaacactggagagttcacacaaaagaaaggccttatgagtgcaatgaatgtgggaaattctttagccaaaactccattctcattaagcatcagaaagttcatactggagaaaagccttataaatgcagtgaatgtgggaaattctttagccgaaaatccagccttatttgtcactggagagttcacactggagaaaggccttacgaatgcagtgaatgtgggagagcctttagcagtaactcccacctggttcgtcatcagagagttcacacacaagaaaggccctatgagtgcatccagtgtggaaaagcctttagtgaaagatctacacttgttcggcaccagaaagttcacaccagagaaaggacttatgagtgtagccagtgtgggaaactcttcagccatctttgtaaccttgcacagcataaaaagattcatacctgagtggagccttatggaagtggtctttgtgagaaaatcttcagccaagtcaaacttcatgcagcagaatccccataccagaaaaattacctacatgtactgctaatgtggaaaagccttcagaagctactctgtttctgaccagcccaggaacctttgcagggccatctcacccatgcagcataaggcagaagccatagtcactttccatcttgcctggatccaaaaatttgcagcagtcctgtcctcatgcatggggaaaacagtaccctgagccttccttcctgtgttctctagggattcaggactgtgctcagctgaaccgatgctggttgaggggccttgagggaaatctaatttgagctcaggaagatgcacattccttgtggatgtggtcaagtctgtgtttaacccctaagatgtgtccattgaggccacaaatcaccctccactggaatcacctaccttgcctgcactaactggtgataataaagaccttattgatcaggtc

SEQ ID NO: 34 - DNA, 2629 bp, Homo sapien
atggccctgcccagcccacaggttctaatggggttgccagcgttgctgatgggcccggcgcagcatacttcttggccctgtggctcagctgtccccacattgaagagcatggtaacctttgaagatgtggctgtatacttctcccaagaggagtgggagctccttgatgcagcccagaggcacctgtaccacagtgtgatgctggaaaaccttgagcttgtgacctcacttggttcttggcatggagtagagggtgagggggcccatcccaagcagaatgtttctgtagaagtgttacaggtcaggatccctaatgcagatccttccaccaagaaagctaactcctgtgacatgtgtgggccattcttgaaagacattttgcacctggctgagcatcagggaacacagtctgaggagaaaccctacacatgtggagcatgtgggagagacttttggttgaatgcaaaccttcaccagcaccagaaggagcacagtggagggaagccctttagatggtacaaggacagggacgcacttatgaagagctctaaagtccacctgtcagagaaccccttcacttgcagggaaggtgggaaggtcatcctgggcagctgtgacctcctccagcttcaagctgttgacagtgggcagaagccatattccaatcttgggcagcttccagaagtctgtaccacacagaaactcttcgagtgcagcaactgtggaaaagccttcctgaagagctccactctccccaaccatctgagaactcactctgaagagataccatttacatgcccaacaggtggaaatttcttagaggagaaatcaatccttggtaataaaaaatttcacactggggaaataccccatgtgtgtaaggagtgtgggaaggcctttagtcactcatctaagctgaggaagcaccagaaatttcacactgaagtaaaatattatgagtgcattgcatgtgggaaaaccttcaaccacaaactcacatttgttcatcatcagagaattcactcaggagaaagaccttatgagtgtgatgaatgtgggaaagccttcagtaacagatcacacctcattcggcatgagaaagttcacactggagaaaggccttttgagtgcctgaaatgtggaagagccttcagccaaagctccaatttccttcggcatcagaaagttcacacacaggtaagaccttatgagtgcagtcaatgtggtaaatccttcagccgaagctctgctctcattcagcactggagagttcacactggagaaagaccgtatgaatgcagtgaatgtggaagagcttttaacaataactccaaccttgctcagcaccagaaagttcacaccggagaacggccttttgagtgcagtgaatgtggaagagacttcagccaaagctcccatctccttcgacatcagaaagttcacactggagaacggccttttgaatgctgtgattgtggtaaagccttcagtaatagctccaccctcatccagcaccagaaagtacatactgggcaaaggccttatgagtgcagcgaatgtaggaaatccttcagccgcagctccagcctgattcagcactggagaattcacactggagaaaagccttacgagtgtagtgagtgtgggaaagcctttgctcacagctccactctcattgaacactggagagttcacacaaaagaaaggccttatgagtgcaatgaatgtgggaaattctttagccaaaactccattctcattaagcatcagaaagttcatactggagaaaagccttataaatgcagtgaatgtgggaaattctttagccgaaaatccagccttatttgtcactggagagttcacactggagaaaggccttacgaatgcagtgaatgtgggagagcctttagcagtaactcccacctggttcgtcatcagagagttcacacacaagaaaggccctatgagtgcatccagtgtggaaaagcctttagtgaaagatctacacttgttcggcaccagaaagttcacaccagagaaaggacttatgagtgtagccagtgtgggaaactcttcagccatctttgtaaccttgcacagcataaaaagattcatacctgagtggagccttatggaagtggtctttgtgagaaaatcttcagccaagtcaaacttcatgcagcagaatccccataccagaaaaattacctacatgtactgctaatgtggaaaagccttcagaagctactctgtttctgaccagcccaggaacctttgcagggccatctcacccatgcagcataaggcagaagccatagtcactttccatcttgcctggatccaaaaatttgcagcagtcctgtcctcatgcatggggaaaacagtaccctgagccttccttcctgtgttctctagggattcaggactgtgctcagctgaaccgatgctggttgaggggccttgagggaaatctaatttgagctcaggaagatgcacattccttgtggatgtggtcaagtctgtgtttaacccctaagatgtgtccattgaggccacaaatcaccctccactggaatcacctaccttgcctgcactaactggtgataataaagaccttattgatcaggtc

SEQ ID NO: 35 - DNA, 3365 bp, Homo sapien
gcggagacggcggaagcggagagcaacagcgcgccgagacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagaggggattctgatgcacataaagcccgagaaccactgctcaaagttatcagggaataccaagagcagagagagcatccaggaacctagatctgattactacaatcatgaagttcctgatattgacctcagtgattgtgaattcccacatgtcattgaaatttatgactttccccaagaatttcgtactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacatat

SEQ ID NO: 36 - DNA, 3420 bp, Homo sapien
gcggagacggcggaagcggagagcaacagcgcgccgagacttccagtgtcctactattgaagcctgcacctgctgcattgctgttttcctgagacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagaggggattctgatgcacataaagcccgagaaccactgctcaaagttatcagggaataccaagagcagagagagcatccaggaacctagatctgattactacaatcatgaagttcctgatattgacctcagtgattgtgaattcccacatgtcattgaaatttatgactttccccaagaatttcgtactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacatat

SEQ ID NO: 37 - DNA, 2087 bp, Homo sapien
ccgtagggggcggtgtcggagttctgtctgggcctattcgggtccgagttcggaatttcggttcaaggcccagttcctcggattgttcctgcgcaacttcagtttcccttccaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcactcgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagccggtgc

SEQ ID NO: 38 - DNA, 2111 bp, Homo sapien
ctctcgtgccgcaccgtagggggcggtgtcggagttctgtctgggcctattcgggtccgagttcggaatttcggttcaaggcccagttcctcggattgttcctgcgcaacttcagtttcccttccaggcacgggcaatgagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcactcgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagccggtgc

SEQ ID NO: 39 - DNA, 1958 bp, Homo sapien
ctctcgtgccgcaccgtagggggcggtgtcggagttctgtctgggcctattcgggtccgagttcggaatttcggttcaaggcccagttcctcggattgttcctgcgcaacttcagtttcccttccaggcacgggcaatagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcactcgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagccggtgc

SEQ ID NO: 40 - DNA, 3014 bp, Homo sapien
gacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaaggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagaggttgtgttttcatcttaccctggattttcaacctcagagacaaccaagatatgttcacttcctcccatattcgagatccttcctgtgaagtcactgaaggccaggaaccagacgctggccccacccttcccagagctgagataccttagcctggcctacaacaagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctg

SEQ ID NO: 41 - DNA, 2987 bp, Homo sapien
gacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaaggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgcctttgtcctttgactttagtgtctggctgaaagccaagggagctgaccagatattacttagtgccgggggcaggctttacaaagaggactggggtggctgtgttggagaccagccagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagaggttgtgttttcatcttaccctggattttcaacctcagagacaaccaagatatgttcacttcctcccatattcgagatccttcctgtgaagtcactgaaggccaggaaccagacgctggccccacccttcccagagctgagataccttagcctggcctacaacaagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctg

SEQ ID NO: 42 - DNA, 3101 bp, Homo sapien
gctcggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaatcccagcactttgtgaggcctaggatggtctcaatctcctgacctcgtgatccgcccgcctaagtgctgggattacaggcgtgagccactgcgcccggcctccttcatccattcttagatcttatcctctaaacctttagtcatcgtttcactctcctttgattccttgttatgggtctttcaactctggaaagacaaagagatagtgggagaggaagcccggtcactgagcatctacagagggctaaatatatttattctcatttgttattcccaatattctctgtattgtgatttccatttcacagatgaggaagctgagggctagaaacatgcagtactttgcccaaagtcacacacatattaagaagagctgaggtatgaatctgggtctgcctgactcaaagcccaaacgctttcctttgcatcgtgtcacaaagtcatagaccatgacattgtttgtatcttcaagaccagttattaactttctggctccaaggagatcccctgcccaagtgcctaggggcagtagacagctgtctcagggacagtcgtagcatgtgctggattattagtgcagcagctgacactttttcccagaagggagagaggcagcaagtcagaaagttcacgggaatgagttgggagggggtcccagggaagggggacaggctgccaggagaaggaaagtacacgggagaaaatagtggggctctgatgagttagtagggttctgttaccaataaaattgtttccataaactgtacatgtgcttgatgtcaaattatctatgcattttaagtagaaaatagattagtaaattctagtgtttgtagaggactttttttagtctgatatgccctaatcagatactctcagcacctaagatac

SEQ ID NO: 43 - DNA, 2656 bp, Homo sapien
ttcccacccccaggctccgcgttcccgccggccccagctccagccccgcagcccaccgggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggcaggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaaaaagagagggatggagtcaactgtgccccagacattaagcccccttcagtgaggaggggcaaggtgctcaggcctgcctgtgtggcccccaggagtcagacctcagcctcatgctcactggtccattttcctccagggaaaatggagttctttctgccttcagagatgcccacacataaggcacatgaggctgttggtgacaccatcaccaacactggagattccctttctgacaagtcccagccaaagaaagattttgcatttgtcttctctgtcctctgcttgtctctgataccagtgactgacagccaccttccttcttccctctcttggtgtgatcatggctaactgcagcctcaatcaccag

SEQ ID NO: 44 - DNA, 2939 bp, Homo sapien
ttcccacccccaggctccgcgttcccgccggccccagctccagccccgcagcccaccgggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggcaggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaatcccagcactttgtgaggcctaggatggtctcaatctcctgacctcgtgatccgcccgcctaagtgctgggattacaggcgtgagccactgcgcccggcctccttcatccattcttagatcttatcctctaaacctttagtcatcgtttcactctcctttgattccttgttatgggtctttcaactctggaaagacaaagagatagtgggagaggaagcccggtcactgagcatctacagagggctaaatatatttattctcatttgttattcccaatattctctgtattgtgatttccatttcacagatgaggaagctgagggctagaaacatgcagtactttgcccaaagtcacacacatattaagaagagctgaggtatgaatctgggtctgcctgactcaaagcccaaacgctttcctttgcatcgtgtcacaaagtcatagaccatgacattgtttgtatcttcaagaccagttattaactttctggctccaaggagatcccctgcccaagtgcctaggggcagtagacagctgtctcagggacagtcgtagcatgtgctggattattagtgcagcagctgacactttttcccagaagggagagaggcagcaagtcagaaagttcacgggaatgagttgggagggggtcccagggaagggggacaggctgccaggagaaggaaagtacacgggagaaaatagtggggctctgatgagttagtagggttctgttaccaataaaattgtttccataaactgtacatgtgcttgatgtcaaattatctatgcattttaagtagaaaatagattagtaaattctagtgtttgtagaggactttttttagtctgatatgccctaatcagatactctcagcacctaagatac

SEQ ID NO: 45 - DNA, 2752 bp, Homo sapien
tcgcgtctccgtttctccgagaggcccaaggtgtctccgccgcagcctctgtcgcgccgtgacctgtacaggtcgcgggagtcgtagggaggacgccgggacacctggaagccgagaaatggattcagtggcctttgaggatgtggctgtgaacttcaccctggaggagtgggctttgctggatccttcccagaagaatctctacagggatgtgatgcgggaaaccttcaggaacctggcttctgtaggaaaacaatgggaagaccagaacattgaagacccattcaaaattcccaggagaaatataagtcatattccagagagactctgtgaaagtaaagaaggtggtcaaggtgaagaaaccttcagccagattccagatggtattctgaacaagaaaactcctggagtaaaaccgtgtgaaagcagtgtgtgtggagaagttggcatgggtccttcatcacttaataggcacatcagagatcacactggacgtgaaccaaatgaatatcaggaatatggaaagaagtcatatacacgtaaccagtgtggacgagccttgagttatcatcgctcttttccagtacgtgaaaggactcatcctggaggaaagccctatgattgtaaggaatgtggagaaacctttatttctcttgtaagcattcgaagacacatgttaacgcataggggaggtgtaccttacaaatgtaaggtgtgtgggaaagcctttgattatcccagtttatttcgtatacatgaaagaagtcacactggagagaaaccttatgaatgcaagcaatgtgggaaagccttcagttgttccagttacattagaatacatgaaaggactcacactggagataaaccctatgaatgcaagcagtgtgggaaagctttcagttgttccaagtacattcgaatccatgaacgaactcacacaggagagaaaccctacgaatgtaaacagtgcggtaaagcctttaggtgcgccagttctgttcgaagtcacgagaggactcacaccggagagaaactttttgaatgtaaggaatgcgggaaggctttgacttgtcttgcaagtgttagaagacacatgataaagcacactggcaatggaccttataaatgtaaggtgtgtgggaaagcctttgatttccccagttcatttcgaatccatgaaaggacccacactggagagaaaccctatgattgtaagcaatgtgggaaagccttcagttgttccagttcgtttcgaaaacatgaaagaattcacactggagagaaaccctataaatgtacaaaatgtgggaaagccttcagtcgttccagttacttccgaatccatgaaagaactcacactggagagaaaccctatgaatgtaagcaatgtgggaaagccttcagtcgatccacttactttcgagtacatgaaaaaattcatactggagagaaaccctatgagaaccctaaccctaacgcttcagttgtcccagttctttcatgagcatgaaaggagtcacatagagaaaccccatgaaagtaagaaatttgggaaagccttcagtcctttctgtttctttcaactacgtgaaaggattcacagtggagaaagaccctgtaagataattggctttaaattacgagagacttgtgataggacagtaaaacctagagttggagttggatctctggattgtgttatgtcagtgttggtaggttaggaactagatttcccagaatccattccatttgtgattccatgatacaattcaccagtaacctatcttacatgagattcggaagtaagttaagaaggcattagtcatggtttggaagcaccatacagggagacagctgtgtgaatacaggctgtatggacacttgcttccatcccattttcctgcttctttgggttgccaatcaagagtatcctcaaaacgacttgactttaattttctcggaggtgataggcttccacacaggtctccagaagccctgcattgaatatccatccacactttggttttccttcagacattattatgtctgtactaggcaactaattcagactgtcctggttgggaatattctgtgatgctctgactcccctagtctgtagacggaattggcatacggtctaatttgtgtagtaagcacctttgttcatactagtagtgactgtattcttgattcagcctgatagctaccatgctgctgtcaaaaccaaccagaggggagcttgttcttctgctgtagtgtgcagtgactggcctcacccaggactttgatgtgagaatgagcactttcctctatcaggaaatttcaagtgtttcctgttattcgtagctcaatgtaatgcctcagttcattttcagttgtttgattatatgtgactaatatgtattttttattcaaacaagacttctgtacatgtttcttcaaaacagtttattaactgtcttcagtcttggattacatcaagtttataattttggcaaattgttgagacactgtgaagtcagcgttaaccatgtgcatacaacttaaggaattttttcctcctcatgtaaattttacttttcatgcttatatagtttcaacttttatcttcatagtaatttctcatctactcataataccaaaagttaagtcatgctgttttgtgtgctctcttgctaaagaccgcagagaccatacctgttgtcaaagagggtgtaataaactgtaataataatcatgaccacaaaccata

SEQ ID NO: 46 - DNA, 1920 bp, Homo sapien
ctcttttctgtctggcccgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccagtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaagtacactcatttcatccagtccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgccggatggagaccatcagccagcacattgctaagagggctcaccgggaggtggactacctcttctgccttgatgtggacatggtgtttcggaacccgtggggccctgagaccttgggagacctggtggctgccattcacccaagctactacgccgttccccgccagcagttcccctatgagcgcaggcgtgtttccactgcctttgtggcagacagcgaaggggacttctattatggtggggcagtcttcggggggcaggtggccagggtatatgagtttactaggggctgccacatggccatcctggcggacaaggccaatggcatcatggctgcctggcgggaggaaagccacctgaaccgtcacttcatctcaaacaagccgtccaaggtgctgtcccccgagtacctctgggacgacaggaagccccagccacccagcctgaagctgatccgcttttctacactggacaaggatatcagctgcctgaggagctgaccacggagctgggggttgccatggatggggacccaaagacctgcagccaccagtgcttcactagcgtgcagaccagccctgtcccgcctccctgtcagtcaggcgaattcaaccggaaaagggacgtggaaaggccactgtgaactgcagagggctgtgcacacagtagcacacaggatctcacagtaacgcggcatgggaacagtgagacagggggaggggaggcgcagttacaaaggcagggcccggcaggcttgccacgttctgcagccgtgcctttgcggggcaggctctgaagcctcagcccgactcagagtgcctgaaccctgccgcgccagtcccccgtttattgcatattgcccttaacgtagcatttctaataccctggtgtgaaggcgccctagaccccttttctctggtcacaggggtcctgggtcctttgatgtctcccaaccacatgtagccaattcctcactcaggcccccagagtgagcctttgaaatggaacaggtctaggctccctcggtttcctgcaccccaaagtgagccgcactctcaggggactagccacctccttcttaagagggtttggggc

SEQ ID NO: 47 - DNA, 3245 bp, Homo sapien
cgggaggcggagcctagggaagcaaattctcctggcggcctccgttcagacgcggcagctgtgacccacctgcctcctccgcagagcaatggcggtgtctgccgggtccgcgcggacctcgcccagctcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttgggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgc

SEQ ID NO: 48 - DNA, 1154 bp, Homo sapien
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcctgaaggagaagccaaatggctgcactggccgattctggtctccagaggaccttggtgtttgctctcccttgacccaccccagtgagtgccaaagggcagccccaacatgtgcacccctgcatttcctgtcatgccacagactggcccttgagggcagcctgctgtactggccatgctgggccagccccacctggagctcagtaaaaactgctgtttgattaaaagctggtatctgtgtgtg

SEQ ID NO: 49 - DNA, 862 bp, Homo sapien
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctatatgtgtgaggcactttctctcttcccattttgcctttggcttttctatttcttttcttcctgaggataccttctggctaaaattctctcatctgaggtccaagttgttggaagggcaaagagtatatgtttggagaagaaagttggagccccc

SEQ ID NO: 50 - DNA, 1893 bp, Homo sapien
agcagggctcccgcgggcgtcactccggccatcgtccccacctccacctgggccgcccggcaggcaggcggtagaacgggcgtggcagacctccctgcaggcttgttgctgggcgaacgagaaggatgccatgctgacacactgacgtgctctgtctccttgcagacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcaatcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcagatgcttgctggccatggagcctcattgcaagttgttcttgaacacctgaggccttcctggtgcccaccaggcactacggcttcctctccagaatgtggctttgcctgagcacagacagagtcagcatggaatgctcttggccaagggtactgggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatcgcacagacagagcttgtgccggatttggccctgtcaaggggactggtgccttgttttcatcactccttcctagttctactgttcaagcttctgaaataaacaggacttgatcacaagtaggtgtgtattgatgctatcatgatgtgctgggggttgggggatagagttattttgcccaggcttcctttacttcttggtcctgtataatctctttggtctctataacccccgattccagccaacaccttgaaccctcaaactcataccttctgcctccaacagccctgatttct

SEQ ID NO: 51 - DNA, 1798 bp, Homo sapien
agcagggctcccgcgggcgtcactccggccatcgtccccacctccacctgggccgcccggcaggcaggcgacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcaatcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcagatgcttgctggccatggagcctcattgcaagttgttcttgaacacctgaggccttcctggtgcccaccaggcactacggcttcctctccagaatgtggctttgcctgagcacagacagagtcagcatggaatgctcttggccaagggtactgggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatcgcacagacagagcttgtgccggatttggccctgtcaaggggactggtgccttgttttcatcactccttcctagttctactgttcaagcttctgaaataaacaggacttgatcacaagtaggtgtgtattgatgctatcatgatgtgctgggggttgggggatagagttattttgcccaggcttcctttacttcttggtcctgtataatctctttggtctctataacccccgattccagccaacaccttgaaccctcaaactcataccttctgcctccaacagccctgatttct

SEQ ID NO: 52 - DNA, 10000 bp, Homo sapien
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagagtggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgacggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaagcctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcagtgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccag

SEQ ID NO: 53 - DNA, 10000 bp, Homo sapien
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagagtggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaagcctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcagtgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcgaatctgtgcagagagtaacgcggagtgtcaagagatgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcacct

SEQ ID NO: 54 - DNA, 10000 bp, Homo sapien
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagagtggaaggaagtcaactgaatttccaagaaaaatacgtgaacaggagccagcacgtcgtgtctcaagatctagcttctcttctgaccctgatgagagtgacggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaagcctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcagtgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcgaatctgtgcagagagtaacgcggagtgtcaagagatgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcag

SEQ ID NO: 55 - DNA, 1196 bp, Homo sapien
ataaagagtgtcataagatatttattctttttaaagaaatacagattctcttaagattccatagttctggctctagagaggaatcagtcatgtagaaaataccagacaggggttacagggggcctggagagaaaaagaaagttcattctccaataaagatgttatgaatcagttggtcagcccattgagtgtgtattctatttttgtagttctatctgaatatgttttacttctttccccctttgcagatcttggcagaaaacctcaccatggtcaccgaattcctgttgctgggtttttccagccttggtgaaattcagctggccctctttgtagtttttctttttctgtatctagtcattcttagtggcaatgtcaccattatcagtgtcatccacctggataaaagcctccacacaccaatgtacttcttccttggcattctctcaacatctgagaccttctacacctttgtcattctacccaagatgctcatcaatctactttctgtggccaggacaatctccttcaactgttgtgctcttcaaatgttcttcttccttggttttgccattaccaactgcctgctattgggtgtgatgggttatgatcgctatgctgccatttgtcaccctctgcattaccccactcttatgagctggcaggtgtgtggaaaactggcagctgcctgtgcaattggtggcttcttggcctctcttacagtagtaaatttagttttcagcctccctttttgtagcgccaacaaagtcaatcattacttctgtgacatctcagcagtcattcttctggcttgtaccaacacagatgttaacgaatttgtgatattcatttgtggagttcttgtacttgtggttccctttctgtttatctgtgtttcttatctctgcattctgaggactatcctgaagattccctcagctgagggcagacggaaagcgttttccacctgcgcctctcacctcagtgttgttattgttcattatggctgtgcttccttcatctacctgaggcctacagcaaactatgtgtccaacaaagacaggctggtgacggtgacatacacgattgtcactccattactaaaccccatggtttatagcctcagaaacaaggatgtccaacttgctatcagaaaagtgttgggcaagaaaggttctctaaaactatataattga

SEQ ID NO: 56 - DNA, 3207 bp, Homo sapien
atggtcctcacccacgaggtgggcgcgaggagcaggctggtactggataggctcaatgtggccacaaagcctggccttggaaggcttggtggggtcccccgcccactaaacgtgaagtccgaacattcccttacatcgacaaagccttttcacacacactgtcccattcagtctcgacacaaccctgtgaggccatcaaggcaagtgctgtcctccgtggtcaccaccagagtgaaggagccaggcttgggcccaggcctccttccccagcccagggtcccttcctctacacaggtcccacctgctccttcttatcgagaagggcggtggcaggtagccactccctcagaagtgaccagagggaacaaacttgtgatactgaagggaaatcagatgctaatgcgttatgcggttgagcgcctatcagcagagattatgtgggtctctcctatagaaagggaagccagttggcttattcgtggccctaaggaagtgagggctgagcagggaggtgctcaaagcgggctcctcacactggctgtctggagtcgctgtgggaagggcccaggggaagaagggttgctggggcctctgaatccccccccgatggaggcagagcctcatccattcccagagagtctctcgccacgagccccggtacagcgcaggctgaccagagaaccggagaaccgggtgattcagttcttcgatacgcagggctggctcttccagagagactggagtcacagcagcagggctgcccttgagatggagttgctgcctctttggctctgcctgggttttcacttcctgaccgtgggctggaggaacagaagcggaacagccacagcagcctcccaaggagtctgcaagttggtgggtggagccgctgactgccgagggcagagcctcgcttcggtgcccagcagcctcccgccccacgcccggatgctcaccctggatgccaaccctctcaagaccctgtggaatcactccctccagccttaccctctcctggagagcctcagcctgcacagctgccacctggagcgcatcagccgcggcgccttccaggagcaaggtcacctgcgcagcctggtcctgggggacaactgcctctcagagaactacgaagagacggcagccgccctccacgccctgccgggcctgcggaggctggacttgtcaggaaacgccctgacggaggacatggcagccctcatgctccagaacctctcctcgctgcggtccgtgtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgagccacaaccagctgtcggagctgcacctggctccggggctggccagctgcctgggcagcctgcgcttgttcaacctgagctccaaccagctcctgggcgtcccccctggcctcttcgccaatgctaggaacatcactacacttgacatgagccacaatcagatctcactttgtcccctgccagctgcctcggaccgggtgggcccccctagctgtgtggatttcaggaatatggcatctttaaggagcctgtctctggagggctgtggcctgggggcattgccagactgcccattccaagggacctccctgacctacttagacctctcaagcaactggggggttctgaatgggagcctcgccccactccaggatgttgcccccatgttacaggtcctgtctctcaggaacatgggcctccactccagctttatggcgttggacttctctgggtttgggaatctcagggacttagatctgtcggggaattgcttgaccaccttcccaaggtttgggggcagcctggccctggagaccctggatctccgtagaaactcgctcacagcccttccccagaaggctgtgtctgagcagctctcgagaggtctgcggaccatctacctcagtcagaatccatatgactgctgtggggtggatggctggggggccctgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtgccctggcttcatacccggagtctctggcagacagacatgactcttccatggagaaaccaagagaataataactggccccgagtttatccagtcagtaagccgactgccagagacagtcctcgttctgaagggaacaaattctgtcccctttccctgcttctcccactccgacctggacccataggagaacctactggcgagggaaggacccacaaagcctgttaccagagttcttcgtgtggtaagcaaatcccttcagctgaatgccctggagaggaagcccagtgcttcctgttgtcttaccaacgctgtaaaatgcaagttagaaataaagcaaaaagggggaaaggggaaaaaaatgggaagctctcctggctagatcggaacgccagcctt

SEQ ID NO: 57 - DNA, 5125 bp, Homo sapien
gccgagcagcccgctctccatgtgacttcagtttccgtccgttccttccgctggtgctaaaataatctgatgccccacagcaaggaggtagcccagccccgcgttcggctgctctcgaggaggccggagcccccggagacgatgcgccccgcgcagccgcctgcgcctgcgggagccgtgagtatttcccgcgtgggggcgtccccggggcacagccggggcccttctccaggtgggcgagctcgagcgagggctgcccttgagatggagttgctgcctctttggctctgcctgggttttcacttcctgaccgtgggctggaggaacagaagcggaacagccacagcagcctcccaaggagtctgcaagttggtgggtggagccgctgactgccgagggcagagcctcgcttcggtgcccagcagcctcccgccccacgcccggatgctcaccctggatgccaaccctctcaagaccctgtggaatcactccctccagccttaccctctcctggagagcctcagcctgcacagctgccacctggagcgcatcagccgcggcgccttccaggagcaaggtcacctgcgcagcctggtcctgggggacaactgcctctcagagaactacgaagagacggcagccgccctccacgccctgccgggcctgcggaggctggacttgtcaggaaacgccctgacggaggacatggcagccctcatgctccagaacctctcctcgctgcggtccgtgtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgagccacaaccagctgtcggagctgcacctggctccggggctggccagctgcctgggcagcctgcgcttgttcaacctgagctccaaccagctcctgggcgtcccccctggcctcttcgccaatgctaggaacatcactacacttgacatgagccacaatcagatctcactttgtcccctgccagctgcctcggaccgggtgggcccccctagctgtgtggatttcaggaatatggcatctttaaggagcctgtctctggagggctgtggcctgggggcattgccagactgcccattccaagggacctccctgacctacttagacctctcaagcaactggggggttctgaatgggagcctcgccccactccaggatgttgcccccatgttacaggtcctgtctctcaggaacatgggcctccactccagctttatggcgttggacttctctgggtttgggaatctcagggacttagatctgtcggggaattgcttgaccaccttcccaaggtttgggggcagcctggccctggagaccctggatctccgtagaaactcgctcacagcccttccccagaaggctgtgtctgagcagctctcgagaggtctgcggaccatctacctcagtcagaatccatatgactgctgtggggtggatggctggggggccctgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaaggtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatgaagaaaactttgatataactcttcttgcttagataaatggttgcagatgacatcacttttagtataacagaacatttctggttttgtttgtattatcttgtaaacatggccaacatggtgaaaccccatctctactaaaaatacaaaaaattagccgggagtggtggcatgcggctgtaatcccagctactcgggaggccgaggcaggagaatcacttgaacccgggaggcagaggttgcagtgagccgagatcgtaccactgcaccccagcctgggcgacagagtgagactccgtcac

SEQ ID NO: 58 - DNA, 6049 bp, Homo sapien
cggccggccggcggtcagccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgccgacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatgttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccggagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtctaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctcctgcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgtatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatcattaagctccttcagtgagggctaagatcctattctcgatgagcatagggggacagccttgttttatgccacttttctctccccatacctaccttcccctcatgtgtacttagccacctgtgttgctttgaatctgctgccagttctggctcaaatgtggcacaaaatcagtacatcagacacaccatgaaatccctgtggctataaattctaaggaatcttttgacacttccagcccaaagaacttatttttatttcgtattatataagagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctg

SEQ ID NO: 59 - DNA, 4176 bp, Homo sapien
ggagccggggcgccagagctagagacagcgggcgggcaaggagctggcagaggcgctggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgcccaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcaacacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatggcaatttgtactcaatttgtcttcttttatttcaagggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatattttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttata

SEQ ID NO: 60 - DNA, 4202 bp, Homo sapien
ggagccggggcgccagagctagagacagcgggcgggcaaggagctggcagaggcgctggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgcccaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcaacacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatggcaaggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttata

SEQ ID NO: 61 - DNA, 2643 bp, Homo sapien
gcacataagtcaaaagctgcgtcagaaggttctaacttttgtcatcactattaccagcattgtcatcgttatcgttatcttcgtcatcatcattaccaccgttatacctgatactgccataacaatcagaacattatgtacaggcacggcatatcttcccaaagatcttggccactatggactacgatctttatttttcttggagtggcggcaatcttgggagtaaccattggtcttcttgttcattttctggcagttgagaagacttactattatcaaggtgattttcatatttctggagtcacatacaatgataattgtgaaaacgcagcttcacaagccagcacaaatctaagcaaagatattgagactaagatgttaaatgcatttcaaaattccagtatatataaggaatatgtcaaatctgaggtcatcaaacttctgcctaatgccaatggttcaaatgtgcagttacagctgaaattcaagtttcctccagcagaaggagttagcatgaggactaaaatcaaggctaaattacatcagatgttgaaaaacaacatggcatcctggaatgcagttcctgcttccattaaactcatggaaatcagcaaggctgcttctgaaatgcttaccaacaactgttgtgggagacaagtagccaacagtatcataactggcaacaaaattgtgaatggaaaaagctccctggagggggcatggccatggcaggccagcatgcaatggaaaggccgtcactactgtggagcctctctgatcagcagcaggtggctattatctgcagctcactgctttgctaagaaaaataattcaaaagattggactgtcaactttggaattgtagtaaataaaccatatatgacacggaaagtccaaaacattatttttcatgaaaattatagcagtcctgggcttcatgatgatattgcccttgtgcagcttgctgaagaagtttcttttacagagtacattcgtaagatttgtcttcctgaagccaaaatgaagctctcagaaaatgacaatgttgtagttacaggttggggaacactttatatgaatggttcatttccagtgatacttcaagaagcctttttgaagattattgacaacaaaatttgcaatgcctcatatgcatactctggctttgtgactgatacaatgttatgtgctggatttatgtcaggagaagctgatgcatgtcagaatgattctggtggaccactagcttaccctgattccagaaatatctggcatcttgttggaatagtaagctggggtgatggatgtggtaaaaagaataagccaggtgtctatactcgagtgacttcttatcgcaattggattacatccaagactggactctgaaaaaaaaggaattatacaaaggaacataaagaccactgtaggctatccttatctgtggctttgggatctttttattttgattgttggtaaactaatcattttattatatataaaaatataaatgtctttattaatattttattatatctaaaacactgtccatgcatttattaatcttttaaattaatgtaagagataggaagaggccaggtgtagtggctcatgcctgtaatcctagcactttgagaggccgagataggcggattgcttgagcccaggagtttgagggcagcctgggaaacatggctaaatccgtgttcaaaaaatacaaaaattagctaggcatggtggcgtgcacctatagtcccagctattcaggaggctgaggtgggaggattgcttgagcccagcaggttgaggctgtggtgatttgtgattgcgccaccactgcactccagcctgggcaacagagtgagaccctgtctcaaaaaaaaaaaaaaaaaaaggagagaagaaaataaagaaggctaatatataatttttcttaatagctgagttgtgattcattttaccattatattcagaattgaccttaatttgttttccagaatcaaaagaaaataaaatataaattttgaaactatgagaacatatataggggatttatcaaatgagttactttttattatatcaattataatttcattttattaactggaataagtgcgaaagtgtacattactttttaacttatatgtgaaatgattcatgtacctcacaaaatcatgcaatcttgcagtgaagaaggagtatcagagctccagctacactgagtctttcaatttacagatcaagaaactgaagaccagagaagagaaatgatttggttaaagtcactctccatcatctgtgataagttgacaaatttatccttacacaaatttgtcctcattgagttgacatccaaaatttgtcaggaattaaagaatgacttttgagtggcaattatttatataacattttccattgtcttcatattcaccttttgtcatttgtttgctttctcttgcagcaaaaataatatgaggtcatcaagggcagagaactgtgtggcatctccttatagtaaaagtgcaatcatatggatggctaactttgtaatctctacaaataatttaccttatgtaattttccaaatgtaaaagtcaccaaaaacttaaaggcattaaaataaactaaaaaagtactcatttcttc

SEQ ID NO: 62 - DNA, 4855 bp, Homo sapien
ccagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcggagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctgctttccttgaccccacgcacgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcgtatgtatcagaaaatataaaactaggcaatttgtcggctcttcgaactttcagagtcctgagagctctaaaaactatttcagttatcccagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaggatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgaggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagatacggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggaggggagaagagagtaggaaaaaggagggaaggacagacatcaagtgccagatgttgtctgaactaatcgagcacttctcaccaaacttcatgtataaataaaatacatatttttaaaacaaaccaataaatggcttacatg

SEQ ID NO: 63 - DNA, 4855 bp, Homo sapien
ccagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcggagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctgctttccttgaccccacgcacgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaggatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgaggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagatacggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggaggggagaagagagtaggaaaaaggagggaaggacagacatcaagtgccagatgttgtctgaactaatcgagcacttctcaccaaacttcatgtataaataaaatacatatttttaaaacaaaccaataaatggcttacatg

SEQ ID NO: 64 - DNA, 4852 bp, Homo sapien
ccagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcggagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctgctttccttgaccccacgcacgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaggatgaggagaacagcctgggcacggaggaggagtccagcaagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgaggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagatacggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggaggggagaagagagtaggaaaaaggagggaaggacagacatcaagtgccagatgttgtctgaactaatcgagcacttctcaccaaacttcatgtataaataaaatacatatttttaaaacaaaccaataaatggcttacatg

SEQ ID NO: 65 - DNA, 2150 bp, Homo sapien
atattggtaaaggcattagggcgaaggtggaacggaacttcctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccc

SEQ ID NO: 66 - DNA, 2359 bp, Homo sapien
ggagaggatcccggagccggtgagaattctctgttttttctctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccc

SEQ ID NO: 67 - DNA, 900 bp, Homo sapien
atgataacttttctatacatttttttttcaattctaataatggttttatttgttctcggaaactttgccaatggcttcatagcactggtaaatttcattgactgggtgaagagaaaaaagatctcctcagctgaccaaattctcactgctctggcggtctccagaattggtttgctctgggcattattattaaattggtatttaactgtgttgaatccagctttttatagtgtagaattaagaattacttcttataatgcctgggttgtaaccaaccatttcagcatgtggcttgctgctaacctcagcatattttatttgctcaagattgccaatttctccaaccttctttttcttcatttaaagaggagagttaggagtgtcattctggtgatactgttggggactttgatatttttggtttgtcatcttcttgtggcaaacatggatgagagtatgtgggcagaagaatatgaaggaaacatgactgggaagatgaaattgaggaatacagtacatctttcatatttgactgtaactaccctatggagcttcataccctttactctgtccctgatatcttttctgatgctaatctgttctctgtataaacatctcaagaagatgcagctccatggagaaggatcgcaagatctcagcaccaaggtccacataaaagctttgcaaactctgatctccttcctcttgttatgtgccattttctttctattcctaatcgtttcggtttggagtcctaggaggctgcggaatgacccggttgtcatggttagcaaggctgttggaaacatatatcttgcattcgactcattcatcctaatttggagaaccaagaagctaaaacacacctttcttttgattttgtgtcagattaggtgctga

SEQ ID NO: 68 - protein, 738 aa, Homo sapien
MEKSRMNLPKGPDTLCFDKDEFMKEDFDVDHFVSDCRKRVQLEELRDDLELYYKLLKTAMVELINKDYADFVNLSTNLVGMDKALNQLSVPLGQLREEVLSLRSSVSEGIRAVDERMSKQEDIRKKKMCVLRLIQVIRSVEKIEKILNSQSSKETSALEASSPLLTGQILERIATEFNQLQFHAVQSKGMPLLDKVRPRIAGITAMLQQSLEGLLLEGLQTSDVDIIRHCLRTYATIDKTRDAEALVGQVLVKPYIDEVIIEQFVESHPNGLQVMYNKLLEFVPHHCRLLREVTGGAISSEKGNTVPGYDFLVNSVWPQIVQGLEEKLPSLFNPGNPDAFHEKYTISMDFVRRLERQCGSQASVKRLRAHPAYHSFNKKWNLPVYFQIRFREIAGSLEAALTDVLEDAPAESPYCLLASHRTWSSLRRCWSDEMFLPLLVHRLWRLTLQILARYSVFVNELSLRPISNESPKEIKKPLVTGSKEPSITQGNTEDQGSGPSETKPVVSISRTQLVYVVADLDKLQEQLPELLEIIKPKLEMIGFKNFSSISAALEDSQSSFSACVPSLSSKIIQDLSDSCFGFLKSALEVPRLYRRTNKEVPTTASSYVDSALKPLFQLQSGHKDKLKQAIIQQWLEGTLSESTHKYYETVSDVLNSVKKMEESLKRLKQARKTTPANPVGPSGGMSDDDKIRLQLALDVEYLGEQIQKLGLQASDIKSFSALAELVAAAKDQATAEQP

SEQ ID NO: 69 - protein, 312 aa, Homo sapien
MSIEKFWDRSSARKEGAEVQIAATWRVSLRLWTLSPLLCREAALDPPPAWRLVPFPDAHPGFSLWLGTPTERAALAGAGATVGLGRRSDSLASCKAGAASPILGCRTRAECQSGCDMKRLAWSLFLSSFPRPSWTRSPCPTFQKAPLPPPRGHTASSPPPLVCGSARSPRGKQEGAGSRSGGQAGAVAPRPLRRAVPGAGAEGDGSAGGPRRGAGWGGAALRHAPAPAEARHAAAVRVLQVQPRGAPLRLGRRVHSPGARGRGARIVLVRGGYRHPQCPETQSVAAAPGAGFSPGPGLHHRPSSMGRSLGSW

SEQ ID NO: 70 - protein, 221 aa, Homo sapien [sequence omitted]

SEQ ID NO: 71 - protein, 408 aa, Homo sapien
MAGRGFSWGPGHLNEDNARFLLLAALIVLYLLGGAAVFSALELAHERQAKQRWEERLANFSRGHNLSRDELRGFLRHYEEATRAGIRVDNVRPRWDFTGAFYFVGTVVSTIGFGMTTPATVGGKIFLIFYGLVGCSSTILFFNLFLERLITIIAYIMKSCHQRQLRRRGALPQESLKDAGQCEVDSLAGWKPSVYYVMLILCTASILISCCASAMYTPIEGWSYFDSLYFCFVAFSTIGFGDLVSSQNAHYESQGLYRFANFVFILMGVCCIYSLFNVISILIKQSLNWILRKMDSGCCPQCQRGLLRSRRNVVMPGSVRNRCNISIETDGVAESDTDGRRLSGEMISMKDLLAANKASLAILQKQLSEMANGCPHQTSTLARDNEFSGGVGAFAIMNNRLAETSGDR

SEQ ID NO: 72 - protein, 58 aa, Homo sapien [sequence omitted]

SEQ ID NO: 73 - protein, 310 aa, Homo sapien
MGGNQTSITEFLLLGFPIGPRIQMLLFGLFSLFYIFILLGNGTILGLISLDSRLHTPMYFFLSHLAVVDIACACNTVPQMLVNLLHPAKPISFAGCMTQMFLFLSFAHTECLLLVVMSYDRYVAICHPLRYSTIMTWKVCITLALTSWILGVLLALVHLVLLLPLSFCGPQKLNHFFCEIMAVLKLACADTHINEVMVLAGAVSVLVGPFFSTVISYVHILCAILKIQSGEGCQKAFSICSSHLCVVGLFYGTAIIMYVEPQYESPKEQKKYLLLFHSLFNPMLNPLIYSLRNKEVQGTLKRMLEKKRTS

SEQ ID NO: 74 - protein, 551 aa, Homo sapien
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 75 - protein, 551 aa, Homo sapien; identical to SEQ ID NO: 74

SEQ ID NO: 76 - protein, 551 aa, Homo sapien; identical to SEQ ID NO: 74

SEQ ID NO: 77 - protein, 551 aa, Homo sapien; identical to SEQ ID NO: 74

SEQ ID NO: 78 - protein, 566 aa, Homo sapien
MEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLRCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 79 - protein, 655 aa, Homo sapien
MEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 80 - protein, 1564 aa, Homo sapien
MAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 81 - protein, 307 aa, Homo sapien
MNHSVVTEFIILGLTKKPELQGIIFLFFLIVYLVAFLGNMLIIIAKIYNNTLHTPMYVFLLTLAVVDIICTTSIIPKMLGTMLTSENTISYAGCMSQLFLFTWSLGAEMVLFTTMAYDRYVAICFPLHYSTVMNHHMCVALLSMVMAIAVTNSWVHTALIMRLTFCGPNTIDHFFCEIPPLLALSCSPVRINEVMVYVADITLAIGDFILTCISYGFIIVAILRIRTVEGKRKAFSTCSSHLTVVTLYYSPVIYTYIRPASSYTFERDKVVAALYTLVTPTLNPMVYSFQNREMQAGIRKVFAFLKH

SEQ ID NO: 82 - protein, 532 aa, Homo sapien
MIQAQESITLEDVAVDFTWEEWQLLGAAQKDLYRDVMLENYSNLVAVGYQASKPDALFKLEQGEQLWTIEDGIHSGACSDIWKVDHVLERLQSESLVNRRKPCHEHDAFENIVHCSKSQFLLGQNHDIFDLRGKSLKSNLTLVNQSKGYEIKNSVEFTGNGDSFLHANHERLHTAIKFPASQKLISTKSQFISPKHQKTRKLEKHHVCSECGKAFIKKSWLTDHQVMHTGEKPHRCSLCEKAFSRKFMLTEHQRTHTGEKPYECPECGKAFLKKSRLNIHQKTHTGEKPYICSECGKGFIQKGNLIVHQRIHTGEKPYICNECGKGFIQKTCLIAHQRFHTGKTPFVCSECGKSCSQKSGLIKHQRIHTGEKPFECSECGKAFSTKQKLIVHQRTHTGERPYGCNECGKAFAYMSCLVKHKRIHTREKQEAAKVENPPAERHSSLHTSDVMQEKNSANGATTQVPSVAPQTSLNISGLLANRNVVLVGQPVVRCAASGDNRGFAQDRNLVNAVNVVVPSVINYVLFYVTENP

SEQ ID NO: 83 - protein, 532 aa, Homo sapien; identical to SEQ ID NO: 82

SEQ ID NO: 84 - protein, 622 aa, Homo sapien
MVKLQRKQIEDQDSSSLGAGVGVEKAGVDGKGATGLGGPCSCSSEAGDGLAEEEEEQVPTDGGTSAEAMQVPLEEDDELEEEEIINDENFLGKRPLDSPEAEELPAMKRPRLLSTKGDTLDVVLLEAREPLSSINTQKIPPMLSPVHVQDSTDLAPPSPEPPMLAPVAKSQMPTAKPLETKSFTPKTKTKTSSPGQKTKSPKTAQSPAMVGSPIRSPKTVSKEKKSPGRSKSPKSPKSPKVTTHIPQTPVRPETPNRTPSATLSEKISKETIQVKQIQTPPDAGKLNSENQPKKAVVADKTIEASIDAVIARACAEREPDPFEFSSGSESEGDIFTSPKRISGPECTTPKASTSANNFTKSGSTPLPLSGGTSSSDNSWTMDASIDEVVRKAKLGTPSNMPPNFPYISSPSVSPPTPEPLHKVYEEKTKLPSSVEIKVEPVALAPSPVIPRLTLRVGAGQDKILLVASNRNPNQTVLEGKTAGVDVTSAGPPAGLPSILGLCPPSSSHLASAVAEVVLATQAVVILGAHSPWRSPASRASVISPREGLRFSSPCGREAALSEGEVCGAQAAPGPLQLEPQWKEQPLSGPPEDSAEVGVGSATSEAVRASAPAQEQAIEVIFL

SEQ ID NO: 85 - protein, 970 aa, Homo sapien
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQLIMGVLGLGFIATYLPESAMSAYLAAVALHIMLSQLTFIFGIMISFHAGPISFFYDIINYCVALPKANSTSILVFLTVVVALRINKCIRISFNQYPIEFPMELFLIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 86 - protein, 970 aa, Homo sapien; identical to SEQ ID NO: 85

SEQ ID NO: 87 - protein, 970 aa, Homo sapien; identical to SEQ ID NO: 85

SEQ ID NO: 88 - protein, 1946 aa, Homo sapien
MVESCLLTFRAFFWWIALIKMDLSDLGEAAAFLRRSEAELLLLQATALDGKKKCWIPDGENAYIEAEVKGSEDDGTVIVETADGESLSIKEDKIQQMNPPEFEMIEDMAMLTHLNEASVLHTLKRRYGQWMIYTYSGLFCVTINPYKWLPVYQKEVMAAYKGKRRSEAPPHIFAVANNAFQDMLHNRENQSILFTGESGAGKTVNSKHIIQYFATIAAMIESRKKQGALEDQIMQANTILEAFGNAKTLRNDNSSRFGKFIRMHFGARGMLSSVDIDIYLLEKSRVIFQQAGERNYHIFYQILSGQKELHDLLLVSANPSDFHFCSCGAVTVESLDDAEELLATEQAMDILGFLPDEKYGCYKLTGAIMHFGNMKFKQKPREEQLEADGTENADKAAFLMGINSSELVKCLIHPRIKVGNEYVTRGQTIEQVTCAVGALSKSMYERMFKWLVARINRALDAKLSRQFFIGILDITGFEILEYNSLEQLCINFTNEKLQQFFNWHMFVLEQEEYKKESIEWVSIGFGLDLQACIDLIEKPMGILSILEEECMFPKATDLTFKTKLFDNHFGKSVHLQKPKPDKKKFEAHFELVHYAGVVPYNISGWLEKNKDLLNETVVAVFQKSSNRLLASLFENYMSTDSAIPFGEKKRKKGASFQTVASLHKENLNKLMTNLKSTAPHFVRCINPNVNKIPGILDPYLVLQQLRCNGVLEGTRICREGFPNRLQYADFKQRYCILNPRTFPKSKFVSSRKAAEELLGSLEIDHTQYRFGITKVFFKAGFLGQLEAIRDERLSKVFTLFQARAQGKLMRIKFQKILEERDALILIQWNIRAFMAVKNWPWMRLFFKIKPLVKSSEVGEEVAGLKEECAQLQKALEKSEFQREELKAKQVSLTQEKNDLILQLQAEQETLANVEEQCEWLIKSKIQLEARVKELSERVEEEEEINSELTARGRKLEDECFELKKEIDDLETMLVKSEKEKRTTEHKVKNLTEEVEFLNEDISKLNRAAKVVQEAHQQTLDDLHMEEEKLSSLSKANLKLEQQVDELEGALEQERKARMNCERELHKLEGNLKLNRESMENLESSQRHLAEELRKKELELSQMNSKVENEKGLVAQLQKTVKELQTQIKDLKEKLEAERTTRAKMERERADLTQDLADLNERLEEVGGSSLAQLEITKKQETKFQKLHRDMEEATLHFETTSASLKKRHADSLAELEGQVENLQQVKQKLEKDKSDLQLEVDDLLTRVEQMTRAKANAEKLCTLYEERLHEATAKLDKVTQLANDLAAQKTKLWSESGEFLRRLEEKEALINQLSREKSNFTRQIEDLRGQLEKETKSQSALAHALQKAQRDCDLLREQYEEEQEVKAELHRTLSKVNAEMVQWRMKYENNVIQRTEDLEDAKKELAIRLQEAAEAMGVANARNASLERARHQLQLELGDALSDLGKVRSAAARLDQKQLQSGKALADWKQKHEESQALLDASQKEVQALSTELLKLKNTYEESIVGQETLRRENKNLQEEISNLTNQVREGTKNLTEMEKVKKLIEEEKTEVQVTLEETEGALERNESKILHFQLELLEAKAELERKLSEKDEEIENFRRKQQCTIDSLQSSLDSEAKSRIEVTRLKKKMEEDLNEMELQLSCANRQVSEATKSLGQLQIQIKDLQMQLDDSTQLNSDLKEQVAVAERRNSLLQSELEDLRSLQEQTERGRRLSEEELLEATERINLFYTQNTSLLSQKKKLEADVARMQKEAEEVVQECQNAEEKAKKAAIEAANLSEELKKKQDTIAHLERTRENMEQTITDLQKRLAEAEQMALMGSRKQIQKLESRVRELEGELEGEIRRSAEAQRGARRLERCIKELTYQAEEDKKNLSRMQTQMDKLQLKVQNYKQQVEVAETQANQYLSKYKKQQHELNEVKERAEVAESQVNKLKIKAREFGKKVQEE

SEQ ID NO: 89 - protein, 2347 aa, Homo sapien [sequence omitted]

SEQ ID NO: 90 - protein, 2260 aa, Homo sapien [sequence omitted]

SEQ ID NO: 91 - protein, 1437 aa, Homo sapien [sequence omitted]

SEQ ID NO: 92 - protein, 701 aa, Homo sapien [sequence omitted]

SEQ ID NO: 93 - protein, 614 aa, Homo sapien [sequence omitted]

SEQ ID NO: 94 - protein, 681 aa, Homo sapien [sequence omitted]

SEQ ID NO: 95 - protein, 580 aa, Homo sapien
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEALERLIHPQLCELCIEALERHVIQAVNTSPERGGEEALHAFLLVHSKLLAFYSSHSASSLRPADLLALILLVQDLYPSESTAEDDIQPSPRRARSSQNIPVQQAWSPHSTGPTGGSSAETETDSFSLPEEYFTPAPSPGDQSSGSTIWLEGGTPPMDALQIAEDTLQTLVPHCPVPSGPRRIFLDANVKESYCPLVPHTMYCLPLWQGINLVLLTRSPSAPLALVLSQLMDGFSMLEKKLKEGPEPGASLRSQPLVGDLRQRMDKFVKNRGAQEIQSTWLEFKAKAFSKSEPGSSWELLQACGKLKRQLCAIYRLNFLTTAPSRGGPHLPQHLQDQVQRLMREKLTDWKDFLLVKSRRNITMLHLPRRLPRLGALHLCGPHHWADGGAFPQLQSKDLVGVGQGAAGCLCQN

SEQ ID NO: 96 - protein, 324 aa, Homo sapien
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEALERLIHPQLCELCIEALERHVIQAVNTSPERGGEEALHAFLLVHSKLLAFYSSHSASSLRPADLLALILLVQDLYPSESTAEDDIQPSPRRARSSQNIPVQQAWSPHSTGPTGGSSAETETDSFSLPEEYFTPAPSPGDQSSGEDRRKAGGNNS

SEQ ID NO: 97 - protein, 701 aa, Homo sapien [sequence omitted]

SEQ ID NO: 98 - protein, 580 aa, Homo sapien; identical to SEQ ID NO: 95

SEQ ID NO: 99 - protein, 166 aa, Homo sapien
MWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQVQFRTPGWPLKALAGRGWPEDASPGQEPSKGAGHGWA

SEQ ID NO: 100 - protein, 589 aa, Homo sapien
MCGPFLKDILHLAEHQGTQSEEKPYTCGACGRDFWLNANLHQHQKEHSGGKPFRWYKDRDALMKSSKVHLSENPFTCREGGKVILGSCDLLQLQAVDSGQKPYSNLGQLPEVCTTQKLFECSNCGKAFLKSSTLPNHLRTHSEEIPFTCPTGGNFLEEKSILGNKKFHTGEIPHVCKECGKAFSHSSKLRKHQKFHTEVKYYECIACGKTFNHKLTFVHHQRIHSGERPYECDECGKAFSNRSHLIRHEKVHTGERPFECLKCGRAFSQSSNFLRHQKVHTQVRPYECSQCGKSFSRSSALIQHWRVHTGERPYECSECGRAFNNNSNLAQHQKVHTGERPFECSECGRDFSQSSHLLRHQKVHTGERPFECCDCGKAFSNSSTLIQHQKVHTGQRPYECSECRKSFSRSSSLIQHWRIHTGEKPYECSECGKAFAHSSTLIEHWRVHTKERPYECNECGKFFSQNSILIKHQKVHTGEKPYKCSECGKFFSRKSSLICHWRVHTGERPYECSECGRAFSSNSHLVRHQRVHTQERPYECIQCGKAFSERSTLVRHQKVHTRERTYECSQCGKLFSHLCNLAQHKKIHT

SEQ ID NO: 101 - protein, 706 aa, Homo sapien
MALPSPQVLMGLPALLMGPAQHTSWPCGSAVPTLKSMVTFEDVAVYFSQEEWELLDAAQRHLYHSVMLENLELVTSLGSWHGVEGEGAHPKQNVSVEVLQVRIPNADPSTKKANSCDMCGPFLKDILHLAEHQGTQSEEKPYTCGACGRDFWLNANLHQHQKEHSGGKPFRWYKDRDALMKSSKVHLSENPFTCREGGKVILGSCDLLQLQAVDSGQKPYSNLGQLPEVCTTQKLFECSNCGKAFLKSSTLPNHLRTHSEEIPFTCPTGGNFLEEKSILGNKKFHTGEIPHVCKECGKAFSHSSKLRKHQKFHTEVKYYECIACGKTFNHKLTFVHHQRIHSGERPYECDECGKAFSNRSHLIRHEKVHTGERPFECLKCGRAFSQSSNFLRHQKVHTQVRPYECSQCGKSFSRSSALIQHWRVHTGERPYECSECGRAFNNNSNLAQHQKVHTGERPFECSECGRDFSQSSHLLRHQKVHTGERPFECCDCGKAFSNSSTLIQHQKVHTGQRPYECSECRKSFSRSSSLIQHWRIHTGEKPYECSECGKAFAHSSTLIEHWRVHTKERPYECNECGKFFSQNSILIKHQKVHTGEKPYKCSECGKFFSRKSSLICHWRVHTGERPYECSECGRAFSSNSHLVRHQRVHTQERPYECIQCGKAFSERSTLVRHQKVHTRERTYECSQCGKLFSHLCNLAQHKKIHT

SEQ ID NO: 102 - protein, 792 aa, Homo sapien
MQQESERCRVRARRPDMALYVPKARRGAVLLKTGDEEESCGSPNSVVKEKQKESSLSQKEVFKDKPEARRLNINPDRKEHNCREEKKSSTKLRMDTCLQKTNRVCSKRGTTESKEVLSQGQQQGAPNAGVITNAPLQRHFKPKKVECLEVETTDVTGHERILLSQACLEISEAQVPSKPFQNVEFCDFSRHEPDGEAFEDKDLEGRIETDTKVLEILYEFPRVFSSVMKPENMIVPIKLSSDSEIVQQSMQTSDGILNPSSGGITTTSVPGSPDGVFDQTCVDFEVESVGGIANSTGFILDQKDTDSIPATMGHISLSESTNDTVSPVMIRECEKNDSTADELHVKHEPPDTAVLAHETHRDSGFKNVGDITNKACMMDTTGMSCSDHVTVDSPYVVAVRIADETSINTRSFSKFVGMSADATPLHVARSGNDTEDFSNPSACSDIYGESISSHFTESTGKLIESLSDCASSLPIKKIAGSNYNTFLDSELSMLNGTKVLSDSAVGIDLGSTGDTTEALHELRTAEEFKTEEQDDSGSIEFGVSFPDRESSSMETSIEPKATETSHTEGITAIEESWESMFNDDGDCLDPRLLQEGILMHIKPENHCSKLSGNTKSRESIQEPRSDYYNHEVPDIDLSDCEFPHVIEIYDFPQEFRTEDLLRVFCSYQKKGFDIKWVDDTHALGVFSSPITARDALGIKHTMVKIRPLSQATRAAKAKARAYAEFLQPAKERPETSAALARRLVISALGVRSKQSKTEREAELKKLQEARERKRLEAKQREDIWEGRDQSTV

SEQ ID NO: 103 - protein, 792 aa, Homo sapien; identical to SEQ ID NO: 102

SEQ ID NO: 104 - protein, 223 aa, Homo sapien
MEVQKEAQRIMTLSVWKMYHSRMQRGGLRLHRSLQLSLVMRSARELYLSAKVEALEPEVSLPAALPSDPRLHPPREAESTAETATPDGEHPFPEPMDTQEAPTAEETSACCAPRPAKVSRKRRSSSLSDGGDAGLVPSKKARLEEKEEEEGASSEVADRLQPPPAQAEGAFPNLARVLQRRFSGLLNCSPAAPPTAPPACEAKPACRPADSMLNVLVRAVVAF

SEQ ID NO: 105 - protein, 223 aa, Homo sapien; identical to SEQ ID NO: 104

SEQ ID NO: 106 - protein, 223 aa, Homo sapien; identical to SEQ ID NO: 104

SEQ ID NO: 107 - protein, 800 aa, Homo sapien
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINVSGLKFSKAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTEVVFSSYPGFSTSETTKICSLPPIFEILPVKSLKARNQTLAPPFPELRYLSLAYNKIAKEDAVLPVALFPSLCEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 108 - protein, 791 aa, Homo sapien
MAFSGIYKLDDGKPYLNNCFPARNLLRVPEEGQGHWLVVQKGNLKKKPKGLVGAQAERRESLKATSFEFKGKKESRRENQVDLPGHILDQAFLPLSFDFSVWLKAKGADQILLSAGGRLYKEDWGGCVGDQPEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTEVVFSSYPGFSTSETTKICSLPPIFEILPVKSLKARNQTLAPPFPELRYLSLAYNKIAKEDAVLPVALFPSLCEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 109 - protein, 366 aa, Homo sapien
MLLLRCQLKQAPPQKVSFRFCVVMGKQQSKLKHSTYKYGPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 110 - protein, 367 aa, Homo sapien
MLLLRCQLKQAPPQKVSFRFCVVMGKQQSKLKHSTYKYGRPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 111 - protein, 367 aa, Homo sapien; identical to SEQ ID NO: 110

SEQ ID NO: 112 - protein, 461 aa, Homo sapien
MDSVAFEDVAVNFTLEEWALLDPSQKNLYRDVMRETFRNLASVGKQWEDQNIEDPFKIPRRNISHIPERLCESKEGGQGEETFSQIPDGILNKKTPGVKPCESSVCGEVGMGPSSLNRHIRDHTGREPNEYQEYGKKSYTRNQCGRALSYHRSFPVRERTHPGGKPYDCKECGETFISLVSIRRHMLTHRGGVPYKCKVCGKAFDYPSLFRIHERSHTGEKPYECKQCGKAFSCSSYIRIHERTHTGDKPYECKQCGKAFSCSKYIRIHERTHTGEKPYECKQCGKAFRCASSVRSHERTHTGEKLFECKECGKALTCLASVRRHMIKHTGNGPYKCKVCGKAFDFPSSFRIHERTHTGEKPYDCKQCGKAFSCSSSFRKHERIHTGEKPYKCTKCGKAFSRSSYFRIHERTHTGEKPYECKQCGKAFSRSTYFRVHEKIHTGEKPYENPNPNASVVPVLS

SEQ ID NO: 113 - protein, 347 aa, Homo sapien
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGKYTHFIQSFLESAEEFFMRGYRVHYYIFTDNPAAVPGVPLGPHRLLSSIPIQGHSHWEETSMRRMETISQHIAKRAHREVDYLFCLDVDMVFRNPWGPETLGDLVAAIHPSYYAVPRQQFPYERRRVSTAFVADSEGDFYYGGAVFGGQVARVYEFTRGCHMAILADKANGIMAAWREESHLNRHFISNKPSKVLSPEYLWDDRKPQPPSLKLIRFSTLDKDISCLRS

SEQ ID NO: 114 - protein, 758 aa, Homo sapien
MAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 115 - protein, 136 aa, Homo sapien
MLLGPPTPLPEALLPCCMPQKAGIELERCQQQANEVTEIMRNNFGKVLERGVKLAELQQRSDQLLDMSSTFNKTTQNLAQKKCWENIRYRICVGLVVVGVLLIILIVLLVVFLPQSSDSSSAPRTQDAGIASGPGN

SEQ ID NO: 116 - protein, 100 aa, Homo sapien
MEEASEGGGNDRVRNLQSEVEGVKNIMTQNVERILARGENLEHLRNKTEDLEATSEHFKTTSQKVARKFWWKNVKMIVLICVIVFIIILFIVLFATGAFS

SEQ ID NO: 117 - protein, 333 aa, Homo sapien
MGDWGFLEKLLDQVQEHSTVVGKIWLTVLFIFRILILGLAGESVWGDEQSDFECNTAQPGCTNVCYDQAFPISHIRYWVLQFLFVSTPTLVYLGHVIYLSRREERLRQKEGELRALPAKDPQVERALAAVERQMAKISVAEDGRLRIRGALMGTYVASVLCKSVLEAGFLYGQWRLYGWTMEPVFVCQRAPCPYLVDCFVSRPTEKTIFIIFMLVVGLISLVLNLLELVHLLCRCLSRGMRARQGQDAPPTQGTSSDPYTDQVFFYLPVGQGPSSPPCPTYNGLSSSEQNWANLTTEERLASSRPPLFLDPPPQNGQKPPSRPSSSASKKQYV

SEQ ID NO: 118 - protein, 333 aa, Homo sapien; identical to SEQ ID NO: 117

SEQ ID NO: 119 - protein, 3256 aa, Homo sapien [sequence omitted]

SEQ ID NO: 120 - protein, 2801 aa, Homo sapien [sequence omitted]

SEQ ID NO: 121 - protein, 2896 aa, Homo sapien [sequence omitted]

SEQ ID NO: 122 - protein, 324 aa, Homo sapien
MFYFFPPLQILAENLTMVTEFLLLGFSSLGEIQLALFVVFLFLYLVILSGNVTIISVIHLDKSLHTPMYFFLGILSTSETFYTFVILPKMLINLLSVARTISFNCCALQMFFFLGFAITNCLLLGVMGYDRYAAICHPLHYPTLMSWQVCGKLAAACAIGGFLASLTVVNLVFSLPFCSANKVNHYFCDISAVILLACTNTDVNEFVIFICGVLVLVVPFLFICVSYLCILRTILKIPSAEGRRKAFSTCASHLSVVIVHYGCASFIYLRPTANYVSNKDRLVTVTYTIVTPLLNPMVYSLRNKDVQLAIRKVLGKKGSLKLYN

SEQ ID NO: 123 - protein, 1069 aa, Homo sapien [sequence omitted]

SEQ ID NO: 124 - protein, 841 aa, Homo sapien [sequence omitted]

SEQ ID NO: 125 - protein, 992 aa, Homo sapien [sequence omitted]

SEQ ID NO: 126 - protein, 1088 aa, Homo sapien [sequence omitted]

SEQ ID NO: 127 - protein, 946 aa, Homo sapien [sequence omitted]

SEQ ID NO: 128 - protein, 416 aa, Homo sapien [sequence omitted]

SEQ ID NO: 129 - protein, 1440 aa, Homo sapien [sequence omitted]

SEQ ID NO: 130 - protein, 1440 aa, Homo sapien [sequence omitted]

SEQ ID NO: 131 - protein, 1439 aa, Homo sapien [sequence omitted]

SEQ ID NO: 132 - protein, 469 aa, Homo sapien
MARGLGAPHWVAVGLLTWATLGLLVAGLGGHDDLHDDLQEDFHGHSHRHSHEDFHHGHSHAHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 133 - protein, 469 aa, Homo sapien; identical to SEQ ID NO: 132

SEQ ID NO: 134 - protein, 299 aa, Homo sapien
MITFLYIFFSILIMVLFVLGNFANGFIALVNFIDWVKRKKISSADQILTALAVSRIGLLWALLLNWYLTVLNPAFYSVELRITSYNAWVVTNHFSMWLAANLSIFYLLKIANFSNLLFLHLKRRVRSVILVILLGTLIFLVCHLLVANMDESMWAEEYEGNMTGKMKLRNTVHLSYLTVTTLWSFIPFTLSLISFLMLICSLYKHLKKMQLHGEGSQDLSTKVHIKALQTLISFLLLCAIFFLFLIVSVWSPRRLRNDPVVMVSKAVGNIYLAFDSFILIWRTKKLKHTFLLILCQIRC

SEQ ID NO: 135 - DNA, 201 bp, Homo sapien
tacaaaagttgggactacaagcaagtgacataaaaagcttctcagctctcgcagagcttgttgctgctgccaaggaccaggcaacagcagagcagccttargcatcttggaagatcccgaggttagattcttaagcaagagaagagttggacttccaggctgaaggggagaaagtgactctgttctcttagcaaccgtctg

SEQ ID NO: 136 - DNA, 201 bp, Homo sapien
gggccacccgcctgcgctccgccgacgcccttggaacaatcggctggagccctgaaacccgacgtggaccttctgctccgagaaatgcagctgctcaaagrccttctgagccgggtggtcctggaattaaaggagccacaggccctccgggagctcaggggaacgcccgagacccccacctctcactttgctgtgagcccg

SEQ ID NO: 137 - DNA, 201 bp, Homo sapien
gctcccagaactaggaaacttatatttaactggtcagaagaaggtatgcaaagtggagaacagcccctgggttaccccaattgctggccagttccagcttsatgtgtcctgtgtgtctgaatgtgtctgttctgagacatatgagtacctctatggcagcacatgcaggcaaatccagaaccaccaaaacataataatcac

SEQ ID NO: 138 - DNA, 201 bp, Homo sapien
catctactccttgttcaatgtcatctctatcctcatcaaacagtccttgaactggatcctgaggaaaatggacagcgggtgctgcccgcaatgccagagargactcttgcgatcacgcaggaacgtggtgatgccaggcagcgtccggaaccgctgcaacatctccatagagacagacggggtggcagagagtgacacgga

SEQ ID NO: 139 - DNA, 164 bp, Homo sapien
acttgctgtaattggaaagccccgagaaggttgagagcacttttgttttcttcatctctgcgtccttatttcttggaacactacctggcaaaccatgggtrcaccatgcagcaagttaaggtcgccgaagtagaactgcgtattaagccagtgtctccatccag

SEQ ID NO: 140 - DNA, 201 bp, Homo sapien
ctttttctgtgaaattatggctgttctcaaacttgcctgtgcggatacccacattaatgaggtaatggttttggcaggggcagtgtctgtgctggtgggasccttcttttccactgtaatatcttatgttcatattctatgtgccattctaaagatccagtcaggagaggggtgccagaaagccttctccatctgctcctc

SEQ ID NO: 141 - DNA, 201 bp, Homo sapien
ctctgaaaaatgatggaaagcgaacaaggagtaagggaactttgcgatacatgagcccagaacagatttcttcgcaagactatggaaaggaagtggacctstacgctttggggctaattcttgctgaacttcttcatgtatgtgacactgcttttgaaacatcaaagtttttcacagacctacgggatggcatcatctcag

SEQ ID NO: 142 - DNA, 201 bp, Homo sapien; identical to SEQ ID NO: 141

SEQ ID NO: 143 - DNA, 201 bp, Homo sapien; identical to SEQ ID NO: 141

SEQ ID NO: 144 - DNA, 201 bp, Homo sapien; identical to SEQ ID NO: 141

SEQ ID NO: 145 - DNA, 201 bp, Homo sapien
gcaataaagtctgcagataatcaggttcctccaccagtcagtgcagctcttcaagggattaaaagtattgtgacactttcaatggccaaaactgaggctgscgttcaaaaacagtggacagctctgattcgtagcacgcttgcttgcatcctggaatattctcaaccagaagactctgtacctacacctgatgaagtaagc

SEQ ID NO: 146 - DNA, 201 bp, Homo sapien; identical to SEQ ID NO: 145

SEQ ID NO: 147 - DNA, 201 bp, Homo sapien; identical to SEQ ID NO: 145

SEQ ID NO: 148 - DNA, 201 bp, Homo sapien
cttcttgttcacatggtctctgggagctgagatggttctcttcaccaccatggcctatgaccgctatgtggccatttgtttccctcttcattacagtactrttatgaaccaccatatgtgtgtagccttgctcagcatggtcatggctattgcagtcaccaattcctgggtgcacacagctcttatcatgaggttgacttt

SEQ ID NO: 149 - DNA, 201 bp, Homo sapien
cccctcagacatcattaaacatcagcggcctcctcgcaaacaggaacgtagtccttgtgggacagccagtggtcagatgtgcagcctcaggagataacagwggatttgcacaggacagaaaccttgtgaatgcagtgaatgtggttgtgccttccgtgatcaattatgtcttattttatgttacagaaaacccataggaag

SEQ ID NO: 150 - DNA, 201 bp, Homo sapien; identical to SEQ ID NO: 149

SEQ ID NO: 151 - DNA, 201 bp, Homo sapien
ttttcttctggatcggaatctgaaggagacatttttactagccctaagagaatttcaggcccggagtgtactactcccaaagcttccacttccgcgaacartttcacaaagtcaggatccactcctctgcctctttccggtggaacctcaagttccgataactcatggacaatggatgcctccattgatgaggttgtacgt

SEQ ID NO: 152 - DNA, 201 bp, Homo sapien
gatttgcaggtgtttctgcaactgtgatgatctggagccgctgcccaggattctttacacagagcgatttgaaaataaactggatcccgaagcatcctccrttaacctgattcactgctcacattttgagagcatgaacacaagccaaactgcatccgaagaccaagtgccatacacagtatcgtccgtgtctcagaaaaa

SEQ ID NO: 153 - DNA, 201 bp, Homo sapien; identical to SEQ ID NO: 152

SEQ ID NO: 154 - DNA, 201 bp, Homo sapien; identical to SEQ ID NO: 152

SEQ ID NO: 155 - DNA, 201 bp, Homo sapien
gaatgagaaaggcctggtagctcagcttcagaagacggttaaagagcttcagactcaaataaaggatttgaaagagaaactagaagctgaaaggaccactygagccaagatggaaagggagagagctgacctcacccaagacctggctgacttgaatgagaggctggaggaggtaggaggatccagtttggctcagctgga

SEQ ID NO: 156 - DNA, 201 bp, Homo sapien
gctgaggaaaaaagaattagaattgagtcagatgaattcaaaagtggagaatgagaaaggcctggtagctcagcttcagaagacggttaaagagcttcagrctcaaataaaggatttgaaagagaaactagaagctgaaaggaccactcgagccaagatggaaagggagagagctgacctcacccaagacctggctgactt

SEQ ID NO: 157 - DNA, 201 bp, Homo sapien
cagtgctgggctcaagaacccgaccaaagacctacttttcatagaattcagaaccaacttcagttattcagaaattttttcttaaatagcatttatcagtscagagatgaagcaaacaacagtggagtcataaatgaaagctttgaaggtgaagatggcgatgtgatttgtttgaattcagatgacattatgccagttgct

SEQ ID NO: 158 - DNA, 201 bp, Homo sapien
actggagccaccaagaaattgtcctgatgatctgtggaatttaatgacccagtgctgggctcaagaacccgaccaaagacctacttttcatagaattcagraccaacttcagttattcagaaattttttcttaaatagcatttatcagtgcagagatgaagcaaacaacagtggagtcataaatgaaagctttgaaggtga

SEQ ID NO: 159 - DNA, 201 bp, Homo sapien
aaatatgcacaacttctgggaagctggacttatactaagactgtgtccagaccgtcctatgtggtcaagcccctgcaccccttcactgagtacattttccragtggtttggatcttcacagcgcagctgcagctctactcccctccaagtcccagttacaggactcatcctcatggagttcctgaaactgcacctttgatt

SEQ ID NO: 160 - DNA, 201 bp, Homo sapien
gacccagtgctgggctcaagaacccgaccaaagacctacttttcatagaattcagaaccaacttcagttattcagaaattttttcttaaatagcatttatmagtgcagagatgaagcaaacaacagtggagtcataaatgaaagctttgaaggtgaagatggcgatgtgatttgtttgaattcagatgacattatgccagt

SEQ ID NO: 161 - DNA, 195 bp, Homo sapien
cagtgctgggctcaagaacccgaccaaagacctacttttcatagaattcagaaccaacttcagttattcagaaattttttcttaaatagcatttatcagtscagagatgaagcaaacaacagtggagtcataaatgaaagctttgaaggtaagtttgattcttcagaattttctagttttcgctgcactgtgaac

SEQ ID NO: 162 - DNA, 201 bp, Homo sapien
actggagccaccaagaaattgtcctgatgatctgtggaatttaatgacccagtgctgggctcaagaacccgaccaaagacctacttttcatagaattcagraccaacttcagttattcagaaattttttcttaaatagcatttatcagtgcagagatgaagcaaacaacagtggagtcataaatgaaagctttgaaggtaa

SEQ ID NO: 163 - DNA, 201 bp, Homo sapien; identical to SEQ ID NO: 159

SEQ ID NO: 164 - DNA, 199 bp, Homo sapien
gacccagtgctgggctcaagaacccgaccaaagacctacttttcatagaattcagaaccaacttcagttattcagaaattttttcttaaatagcatttatmagtgcagagatgaagcaaacaacagtggagtcataaatgaaagctttgaaggtaagtttgattcttcagaattttctagttttcgctgcactgtgaac

SEQ ID NO: 165 - DNA, 201 bp, Homo sapien
ccagccgctgagctacatctaatcttcaacaacaaggagatcttcagctcgccgaaccgcaaaatcaattttgaccgagagaagggcctggtggaagtgaycatccagaacttgtctgaggaggacaaagggtcgtacaccgctcaactccaagatggaaaagccaaaaaccagattaccttgacactggtggatgacgat

SEQ ID NO: 166 - DNA, 201 bp, Homo sapien
ggcgatcctccctccggagccccccttcaaccctcccggaagtgaggaccagggatgctgtgctgctctcccatgagccagtcaccgagtcggtctgctgmagccctttctgaacctctggccgtctggatgctccactgtgcttgccaagatgaagtgcgtcttggtggccactgagggcgcagaggtcctcttctactg

SEQ ID NO: 167 - DNA, 201 bp, Homo sapien
ggcaaggggccgctggctgcctttgtcaaaactaaggtctggtctctgatccagctggcgcgcagatacctgcagaagggctacaccacgctgctgttccrggagggggatttctactgctcctacttcctgtggttcgagaatgacatggggtacaaactccagatgatcgaggtgcccgtcctctccgacgactcagtg

SEQ ID NO: 168 - DNA, 201 bp, Homo sapien
ccctccggagccccccttcaaccctcccggaagtgagcatttgcaggaccagggatgctgtgctgctctcccatgagccagtcaccgagtcggtctgctgmagccctttctgaacctctggccgtctggatgctccactgtgcttgccaagatgaagtgcgtcttggtggccactgagggcgcagaggtcctcttctactg

SEQ ID NO: 169 - DNA, 201 bp, Homo sapien; identical to SEQ ID NO: 167

SEQ ID NO: 170 - DNA, 201 bp, Homo sapien
cgcgcccgggctcctgcaggcggggcgctgtgcgcgccgcgatccggaccagggatgctgtgctgctctcccatgagccagtcaccgagtcggtctgctgmagccctttctgaacctctggccgtctggatgctccactgtgcttgccaagatgaagtgcgtcttggtggccactgagggcgcagaggtcctcttctactg

SEQ ID NO: 171 - DNA, 201 bp, Homo sapien; identical to SEQ ID NO: 167

SEQ ID NO: 172 - DNA, 201 bp, Homo sapien; identical to SEQ ID NO: 166

SEQ ID NO: 173 - DNA, 201 bp, Homo sapien; identical to SEQ ID NO: 167

SEQ ID NO: 174 - DNA, 201 bp, Homo sapien; identical to SEQ ID NO: 170

SEQ ID NO: 175 - DNA, 201 bp, Homo sapien; identical to SEQ ID NO: 170

SEQ ID NO: 176 - DNA, 201 bp, Homo sapien; identical to SEQ ID NO: 167

SEQ ID NO: 177 - DNA, 201 bp, Homo sapien
gctcctgcaggcggggcgctgtgcgcgccgcgatccgcatttgcaggaccagggatgctgtgctgctctcccatgagccagtcaccgagtcggtctgctgmagccctttctgaacctctggccgtctggatgctccactgtgcttgccaagatgaagtgcgtcttggtggccactgagggcgcagaggtcctcttctactg

SEQ ID NO: 178 - DNA, 201 bp, Homo sapien; identical to SEQ ID NO: 167

SEQ ID NO: 179 - DNA, 172 bp, Homo sapien
caattgcccaggtccaattccggaccccaggctggcctctgaaggctcttgctggccgtggctggcctgaggacgcttctcctggccaggagccctccaasggtgctggacatgggtgggcctgaatgctctttgccgagatgaactggacctgtcaaagacaccttcatgc

SEQ ID NO: 180 - DNA, 201 bp, Homo sapien
tttagatggtacaaggacagggacgcacttatgaagagctctaaagtccacctgtcagagaaccccttcacttgcagggaaggtgggaaggtcatcctggrcagctgtgacctcctccagcttcaagctgttgacagtgggcagaagccatattccaatcttgggcagcttccagaagtctgtaccacacagaaactcttc

SEQ ID NO: 181 - DNA, 201 bp, Homo sapien; identical to SEQ ID NO: 180

SEQ ID NO: 182 - DNA, 201 bp, Homo sapien
gacagtgccgtgggcattgacctgggtagtactggtgatacaacagaagcattgcacgaactaagaactgccgaagagttcaaaacagaagagcaagatgmctcagggagtatagaatttggtgtatcttttcctgatagggaatcatcatctatggaaacatccatcgaaccaaaagcaactgaaacttctcacacagag

SEQ ID NO: 183 - DNA, 201 bp, Homo sapien; identical to SEQ ID NO: 182

SEQ ID NO: 184 - DNA, 201 bp, Homo sapien
gaggcgccgacagccgaggagacctccgcctgctgtgccccgcgccccgccaaagtcagccgcaaacgacgcagcagcagcctgagcgacggcggggacgytggactggtcccgagcaagaaagcccgtctggaagaaaaggaagaagaggagggagcgtcatccgaagtcgccgatcgcctgcagccccctccggcgcaa

SEQ ID NO: 185 - DNA, 201 bp, Homo sapien; identical to SEQ ID NO: 184

SEQ ID NO: 186 - DNA, 201 bp, Homo sapien; identical to SEQ ID NO: 184

SEQ ID NO: 187 - DNA, 201 bp, Homo sapien
aagcatcatgttttgatgtctcggaaggaatcatggaaggtgaaaagcgaaatcccaaaggtgccgaagcagcctctggtgctccatcacccgcgcatgasgacaaccaagtctccctcaaaggatatgctagagccagaggcagagctggctgaagatctgcccactaccaaaagcacttctgtggagtcagagatgccc

SEQ ID NO: 188 - DNA, 201 bp, Homo sapien; identical to SEQ ID NO: 187

SEQ ID NO: 189 - DNA, 201 bp, Homo sapien
agggaaagataagacagttgtggcctataattggaaaactggaaatgtggtgaaaaggttcaaaggacatgaacatgagatcaccaaggtagcctgtattyccaaatccagccagttcttcagtgcctctcgtgacaggatggtcatgatgtgggacttgcacggttcctcacaaccaaggcagcaattgtgtggccatgc

SEQ ID NO: 190 - DNA, 201 bp, Homo sapien; identical to SEQ ID NO: 189

SEQ ID NO: 191 - DNA, 201 bp, Homo sapien; identical to SEQ ID NO: 189

SEQ ID NO: 192 - DNA, 201 bp, Homo sapien
tgagcatgaaaggagtcacatagagaaaccccatgaaagtaagaaatttgggaaagccttcagtcctttctgtttctttcaactacgtgaaaggattcacrgtggagaaagaccctgtaagataattggctttaaattacgagagacttgtgataggacagtaaaacctagagttggagttggatctctggattgtgttat

SEQ ID NO: 193 - DNA, 201 bp, Homo sapien
ccatcgtctccgagggaaccttcaacccagagcttctgcagcacatctaccagccactgaacctgaccattggggtcacggtgtttgccgtggggaagtamactcatttcatccagtccttcctggagtcagccgaggagttcttcatgcgtgggtaccgggtgcactactacatcttcactgacaaccctgcagccgttc

SEQ ID NO: 194 - DNA, 201 bp, Homo sapien
cagcttttcagcattggtatgttctcctacgtcatgctggccagcagccctctcttctgctcccctgagtggcctcggaagctggtgtcctactgcccccraaggttgcaacaactgttgcccctcaaggcagcccctcagcccagtgtttcctgtgtgtataagaggagccggggcaaaagtggccagaagccagggctg

SEQ ID NO: 195 - DNA, 201 bp, Homo sapien
agcagctattcctgccctattctcattttctcacccagggctataacaactggacaaatgggctgtatggctattcctgggacatgatggtgcactcccgytcccaccagcacgtgaagatcacctaccgtgatggccgcactggcgaactgggctaccttaaccctggggtatttacacagagtcggcgatggaaggatc

SEQ ID NO: 196 - DNA, 201 bp, Homo sapien
tcctggcccggggggaaaacttggaacatctccgcaacaagacagaggatctggaagccacatctgagcacttcaagacgacatcgcagaaggtggctcgraaattctggtggaagaacgtgaagatgattgtccttatctgcgtgattgtttttatcatcatcctcttcattgtgctctttgccactggtgccttctctt

SEQ ID NO: 197 - DNA, 201 bp, Homo sapien
cttatctgcgtgattgtttttatcatcatcctcttcattgtgctctttgccactggtgccttctcttaagtaacagggaacctctcccacctgcccttctyttcagggacaaccctccataaatgtgtgccaagagggtctcctttcctgtcttcctctacagagaatgctgctcggtcctcctacccctcttcccgaggc

SEQ ID NO: 198 - DNA, 201 bp, Homo sapien
accctccataaatgtgtgccaagagggtctcctttcctgtcttcctctacagagaatgctgctcggtcctcctacccctcttcccgaggccctgctgccaygttgtatgccccagaaggcaggaatagagttggagcggtgccagcagcaggcgaacgaggtgacggaaattatgcgtaacaacttcggcaaggtcctgga

SEQ ID NO: 199 - DNA, 201 bp, Homo sapien
tgcggaacctgcaaagtgaggtggagggagttaagaatattatgacccagaatgtggagcggatcctggcccggggggaaaacttggaacatctccgcaayaagacagaggatctggaagccacatctgagcacttcaagacgacatcgcagaaggtggctcgaaaattctggtggaagaacgtgaagatgattgtcctta

SEQ ID NO: 200 - DNA, 201 bp, Homo sapien; identical to SEQ ID NO: 196

SEQ ID NO: 201 - DNA, 201 bp, Homo sapien; identical to SEQ ID NO: 197

SEQ ID NO: 202 - DNA, 201 bp, Homo sapien
accctccataaatgtgtgccaagagggtctcctttcctgtcttcctctacagagaatgctgctcggtcctcctacccctcttcccgaggccctgctgccaygttgtatgccccagaaggtaccttggtcccccggaaggagagaaaaaagagagatggactgtggctgcatttcttgggtccttagagtgggctggagaga

SEQ ID NO: 203 - DNA, 201 bp, Homo sapien; identical to SEQ ID NO: 199

SEQ ID NO: 204 - DNA, 201 bp, Homo sapien
atccagtgagcagaactgggccaacctgaccacagaggagaggctggcgtcttccaggccccctctcttcctggacccaccccctcagaatggccaaaaayccccaagtcgtcccagcagctctgcttctaagaagcagtatgtatagaggcctgtggcttatgtcacccaacagaggggtcctgagaagtctggctgcct

SEQ ID NO: 205 - DNA, 201 bp, Homo sapien; identical to SEQ ID NO: 204

SEQ ID NO: 206 - DNA, 201 bp, Homo sapien
cagactccatgtgcctgagatcaagaaagacaaaaagccagcctgcagcaagcactttggagagcgaatctgtgcagagagtaacgcggagtgtcaagagrtgtgcagaaaatccaaagaaggctgaggacaatgtgtgtgtcaagaaaataagaaccagaagtcatagggacagtgaagatatttgacagaaaaatcgaa

SEQ ID NO: 207 - DNA, 201 bp, Homo sapien
cctaaggaaaaggcccaggctctagaagacctggctggctttaaagagctcttccagactcctggtcacaccgaggaattagtggctgctggtaaaaccaytaaaataccctgcgactctccacagtcagacccagtggacaccccaacaagcacaaagcaacgacccaagagaagtatcaggaaagcagatgtagaggga

SEQ ID NO: 208 - DNA, 201 bp, Homo sapien; identical to SEQ ID NO: 206

SEQ ID NO: 209 - DNA, 201 bp, Homo sapien; identical to SEQ ID NO: 207

SEQ ID NO: 210 - DNA, 201 bp, Homo sapien; identical to SEQ ID NO: 206

SEQ ID NO: 211 - DNA, 201 bp, Homo sapien; identical to SEQ ID NO: 207

SEQ ID NO: 212 - DNA, 201 bp, Homo sapien
tcttctggcttgtaccaacacagatgttaacgaatttgtgatattcatttgtggagttcttgtacttgtggttccctttctgtttatctgtgtttcttatytctgcattctgaggactatcctgaagattccctcagctgagggcagacggaaagcgttttccacctgcgcctctcacctcagtgttgttattgttcatta

SEQ ID NO: 213 - DNA, 201 bp, Homo sapien
ctggggggttctgaatgggagcctcgccccactccaggatgttgcccccatgttacaggtcctgtctctcaggaacatgggcctccactccagctttatgscgttggacttctctgggtttgggaatctcagggacttagatctgtcggggaattgcttgaccaccttcccaaggtttgggggcagcctggccctggagac

SEQ ID NO: 214 - DNA, 201 bp, Homo sapien; identical to SEQ ID NO: 213

SEQ ID NO: 215 - DNA, 201 bp, Homo sapien
gctagcaagtctaggctgaggttctcatccagtaaaatttctccagcactaagtgtgactgaagcacaagacaagattctttattgtctccaggaaggcartgtggagtctgagactctatccatgtctgcgatggaatcttttattgaaaaacagacaaagttactggaaatgcagccaacaaaagccccagaaaaagat

SEQ ID NO: 216 - DNA, 201 bp, Homo sapien
caaaagtttcttcgtcttatctttgggaccctagttcaaaggtggctagaggtgcaggtagctaatttaacaagtccacagcgctgggtgcagtacctcckgcttcttcaggagtccatctggcctggtggagttttgcctaagtttccacggcccgtaaggacccaagagcagaaactggctgctgagaaacaggctttg

SEQ ID NO: 217 - DNA, 201 bp, Homo sapien
aatggatattgccaagggaacaatcagaactcatctggctttgaaaacgacctgccaagtttggctagcaggttcagacaacaagagagtaacaattggtrgagagccacaggtagaaaagatactcccagctgacagggtgataaaaggcagggaagaattgggcctgtgctgatccaggaaggttttattgtttgcttg

SEQ ID NO: 218 - DNA, 201 bp, Homo sapien
agtaggctacagctaagaaggcctaggttctcggtggctcacttctctcccacttctgctccatttgtagcaggtgacaggggtctgtgtgtcccagttgyatgcacgtttatttccctgttccttttgtgatgttgggattgttgctggtgagtagatcctgtttcctttgggaaaagaagctgtgaggtagaggaatga

SEQ ID NO: 219 - DNA, 201 bp, Homo sapien
aactgcatgacaagctgcatattcagcctcagtttttccaaggagaatggaaagcacttgcctcctgtcttaagaatgcacaaagagtaggactagcaagsctgggggatgaaatctcccttcctaagtctttgacagagaacttttattattctgaacagataagattagcaaacttacaaggaatagcttcttatttcc

SEQ ID NO: 220 - DNA, 201 bp, Homo sapien
ttctttgaaacatcaaacaagaaatcagtgtcagaacaatcctagtgaaatcatccaaagtacgtatcaggagacacagaacaaaagttctagtttatcarcttcctcaattttgtctcagcacaaagaaaataacttagatttgacaagcagattcaaggagcaagaaatgagcaatggaattgataaacagtattcaaa

SEQ ID NO: 221 - DNA, 201 bp, Homo sapien; identical to SEQ ID NO: 220

SEQ ID NO: 222 - DNA, 201 bp, Homo sapien
ctactgtggagcctctctgatcagcagcaggtggctattatctgcagctcactgctttgctaagaaaaataattcaaaagattggactgtcaactttggarttgtagtaaataaaccatatatgacacggaaagtccaaaacattatttttcatgaaaattatagcagtcctgggcttcatgatgatattgcccttgtgca

SEQ ID NO: 223 - DNA, 201 bp, Homo sapien
agccgcgggagcattttcacctttcgcaggcgagacctgggttctgaagcagattttgcagatgatgaaaacagcacagcgggggagagcgagagccaccrcacatcactgctggtgccctggcccctgcgccggaccagtgcccagggacagcccagtcccggaacctcggctcctggccacgccctccatggcaaaaag

SEQ ID NO: 224 - DNA, 201 bp, Homo sapien; identical to SEQ ID NO: 223

SEQ ID NO: 225 - DNA, 201 bp, Homo sapien; identical to SEQ ID NO: 223

SEQ ID NO: 226 - DNA, 201 bp, Homo sapien
tggccatagccatggctactcccatgagagcctctaccacagaggacatggacatgaccatgagcatagccatggaggctatggggagtctggggctccasgcatcaagcaggacctggatgctgtcactctctgggcttatgcactgggggccacagtgctgatctcagcagctccattttttgtcctcttccttatccc

SEQ ID NO: 227 - DNA, 201 bp, Homo sapien; identical to SEQ ID NO: 226

SEQ ID NO: 228 - DNA, 201 bp, Homo sapien
aatacagtacatctttcatatttgactgtaactaccctatggagcttcataccctttactctgtccctgatatcttttctgatgctaatctgttctctgtrtaaacatctcaagaagatgcagctccatggagaaggatcgcaagatctcagcaccaaggtccacataaaagctttgcaaactctgatctccttcctcttg

SEQ ID NO: 229 - DNA, 10000 bp, Homo sapien
atgccagtagtgacccttccctcagtagtgccaccaaagatgtctccagacattgccaaaacccatggggagaagagtggacaaaaccttccccaggtgagaaccactgatctagatgaccgatgacagtggcatgcactagagcagtagatgggcaggtggggagaagtggtgagattctgtatgtgttttgaaggcaaaacacacagaatttgttgatgcattatgcgtggatcctgtgaacaagataaggattaggaagattttaagatttttggcctgaggcaatggaacaataaagctgctgcttaccaagatgggaaagactacaggaggagcaagttagaggaaatcaggagtctggttttggatgtgttgaatttgagatgcctgttaaatccacatggaggtgacaagtaggcagttggatatacaagtcaggagttcaggaatgaggtccaggctagagacagaaatgtgacagtcattagaacagaggtgttacttaaagccttgaggctgggagagcttgtctgtgcagggagtagagatagggaaggtgtgttaggcagcattttaagatggccatctgatatctgacctatgttatgtcctttgaaagtagacaggacgtagacttgcttctaactagtagaatatggtgaggtaaggggttgtccctcctacaagtacaccatgttacataagtctgtttttttgctgactggaatcagaggctttcctgctgactttgaagaagcaaagggcttcttgacaaccactgtggagaggtctcatggcagggaactgcaggagacctctaggagcagagggcagactccaacagatagccaaaaagaggctggggccctcagacatatgggtgcaagaaaatgaattctgccaaaaatctaaatgagtttggaaatagattcttccccagctgaacctgcagatgagaacatagcccagtcatgccttcatttttgccttgagggagactctgagttaagcaaaaacaggtctgagttcaggagcacattggtgctgaaaagttgaggtcaggacaagccaacaaagactggcagaaaacaaaggcagagtcagaagctaagtgaataaaatgaaacattttgagaaaaacagagggactactgtgtcaattgggactgacaggttgagtaatctgaggtctgagaatgacttatgggatttggcaaagtggtgattatgagtgaccttgaaatgaccttgaaaaacagctgtctccctagagtagcgggactgaaagcctgatggcagtaactgaggttaaaacacacacacacagacacacacacacacacgtcaggatttggattcatatgggaacagcaatcaagtctgcattctgttttggaggtaacatcaataggacttgctgacagatgggaataggggaagggagaagtcatcccaaaggtggaagccctagccactgggtaggaggcaatgccttttactaaaatgggagaaaaccaggagaggaacaggtagaggagggaaccagttaaagttatgttaaaaacctggtgtctcttaacatatccccacagagaaattccataggcagttggatatgagtctgagctcaataaacaggtcaggattagaacttcagagcgttccatttacagaaagtacttaaaccaatgatactgtctagaatcattgagaacagtggttctgaaactgagagatgagggtacataggaggtggcgatcttgcttccagggcacactgggcaatgtctggaggcattttttattgtcacaattcaggcagggagtgctactggcaactagtgtgtagaggccagggatactgccaaatatcctacaatacacaacaaagaataatatagcccaaaatgtcagttgtgccaaggttgacaaatcctggtctagaaagcacgttgctatagaaggagactcagaatcaagctctggggaatctgaaatgtggaggtcagataggaaagggtaatccttaagggagatttaggatataggtccagaatagcagggagaacacctacgtgactatgataaactaagaaaagaacaggaagtgagaaccgggagaccccgagcacaggttgctaggagtagacgtctttgctcacacacctcctgatagaatttatataccatcttgaacatttttaagttgacacctgaaatagttcatcataagtctatattttttaaaattatttataggctgaaaatatttagtattttaaaaatataacataggaaaagattgacttgattggaataaaacttgcctgatacaatttactgttttttaaatgctagctttcagttattctctttacttaaccatactgaatctgaaaaacccctgttaaaatgctgatttgtgtttctacccccattgtatctggacacttttggtagtccctcaaaccaatttagtttaatttaaaagaatcaatgtcactaacccaaagggattctgcttttctgatttcagagcatgctaacagtaacccaaagactgtttctaatgataccctttgctcttaacaagaaagaaaggaagtcctaagtgttgatgtttctgttaaaaaattaagggagaccagttttttggggctgaggtcctgcgctaggcctcaatggaccagactaaactaaaatggagtcactcgtactgactgccatttaatcaaactgaaactttaaggaaggagatagatctccaaacagaccagttttttcctgaaaacaggagattccagtccacttgtgtcagcatcatacggacgtttcccctgctttaacccctacaagtcacctcctgaagtaacctgatgttaaccaatcagcttcttttttactattgttccgtttccttgttctcaccttacaaaccacccccgttctgcaatttcccagtgggacctcttgttctatttttttttttttttttttttttgagactgagtctcactctgtcgcccaggctggagcgcagtggcacaatctctgctcactgcaacctccgcctcccaggttcaagtggttctcctgcctcagcctcccgagtagctgggattacaggtgcccgccaccacacctggctaatttttgtatttttagtagagacggggtttcaccatgttggccaggctggtcatgaactcctgacctcaggtgatccgcccaccttggcctcccaaagtgctgggattataggcgtgagccaccgcatctggccttcttgttctattttgtaggatggtggctgccctgatccatgaatcataaataaaaggaagttagatttatcactaatgatatctgatgcattcttgggcatatcagttctactacagagtgtatatggaaggagaagatctggaaagggactctcttataatgatctgtgcacaagattgtatagagagttttcaggtatccccaggggaatggtaaccaagttgggcaaccagggtataaagaagtattttacaagctatactgtgaatgacggcagggcaggaaactcagaggttgctgacaggagtggtccatgagaaagtaggcattgaggccaggcgcagtggctcacgcctgtaatcccagcactttgggaggctgacaagggtggatcacttgaggccaggagttgaaaaccagcctggtcaatatggtgaaacccatctctactaaaaatacaaaaattagttgggcatggtggcgcatgcctgtaatctcagctactcgggaggctgagggaggagaattgcttgaatgggtacccgggaggtggaggctgcagtgagcagagatcctgccactgcactccagcctgggctacagagtgagactctgtctcaaaaaaaaaaaaaaaaaaaaaagaaagaaaaaaaaaaaaaaagaaaagaaaaagcaaaaagaaaagaaaggaggcattgagttacctcccagagtggagtcctggaaagggctggagagaatgagtcccaagcacccgaggagggaactgactgtgtgacagtggggatacttgctcccctatgacagtctctcaccgctcttctcactaactcggctttatctttagtgaacttttagtttttattagtttatcgtgcatctgttccattacaatggaaattccatgatgagagggacttttctgtattgttcattactgaattaccagtgctcagtgtattgcctaccatagagtaggtgtttaataaatgcgtgtggaataaatgataaaaaatgaaaatacctggacacagatatagtatagatgtgatctgatggtaagaacatgtgagaattgttgtgcaatttgcttctgtttccccaacaaaaggtgacagaagggcatgagctaagacagagggggcgttgtggggaagaagtaggggagaaagttgcggcaagtcttgaaggcatgaactagtcattttcattagagagaaagcaagcctgctggagatacaagggagttcgcagtcactgctgagtatcctgctggggctcagaaactggtgccctgacatatggcactttgacacgttgaactggagaagcagcctcaaggtctctaccaccccctcctcttctctggctccagttctttgtctctcctaaagcacaggatgaagttcttctctgaggttccctaatatacctggaaaccagacccccaaagaggaacacaattgccctccacccattccctgaaatctcattctgtatcacaggaaggaagactgaggagtacaaccacatctggatggacttttccacaagacactgtctgcctctagggctcatctaaattccaaagagaatcattttcaggttactttctgtctcctgggtccattcatttcccctgtaaattatttcagtcctacacccccatctccccacttcccaataaagagcatacttaagcatcaaccagctggctgttttggagttttcatgttttgtatgattccagtgcacatgtgtgcacttagtaaatttctgatgcttttctctgttaacctgtcttttgttataggagtgtcagccttgaccctttatgatggggaggaaggggatcaccccttttctgcctctgcacccatttgaggtttgtggttgagtattttaaagtgcaactggttggctcagttctgtgattgatttctaggtgtttggcttatgcagctggcatttggtggagccatttatcaagaaacaaaatgaaggaggataagaaagcctttcaggaaagataatgaatcaatttcgaacatgctgagtttgaggcatcagtgggacatcaaagtgaagtagtattatacatgggtctagtggaggggggaaagaagcacatggtgaagatgtgacgggagaattgtgagtatgtggaccagagctgaaaccctaagggcacagctgagatgactgtgggagagggtagcatggaagagaaaggttagcagaaccccgaggagcactaattgtgaaagagtcgcatacatttatcatgcttgaaggtcgtgtctctctaagcagattctgagctcttcagggtcaaaggctgggtcttgagcttcattcattcttagcccctgtcatagtgctggccacacagaagacaattctaaaattcactctgattttatttctctgcactttcatttatgaggatcctatcacggtttatgatttgaaatgctaagggataattttttttaaatcataactttcatacgaatataaaaagaatacttgtaaagatttgaactcagtacttaacaagagaactagtaaaatgttatcaccacttcaagagacaatctaaagagcagacaaatatacagccaaggatgtgcgaatgaacttccctaagatatgcaaaactggctttttccaaaggaaattgaggcaagatgggtcaactttactttcacaggataaaatttatttgcatgtttatagacaaatgttactattatttgcattgctatcagttatgcacaacttacagagttgtaaaatagcttaaagtcaagaaaggcacaggatacaccatagagtcacatctggaatggcatgctagactgactctttttcctttgaagacaactgtaaccttcttggttcatttcaaagtcacaatttctcctgtaatgctaaaaaggaaaagatattatccctaccatttctatgagcggggtctattacaaaacatagatgaaagtatatttgggtattactataacatttcctagttgatgagggagatgaggctgaattggggaccccccctaacataatgtcttctaattggcatgggaaatgttcacgaatcaaaccaaaccacctcaaatccaccctggaatgaggcagagttataaacaaaatatagaagatgttgaaatagcccagttggttcattgagctttccaagtcagagtgcaggtcctgaaggtggtgactgtctcccctgtcccctgctgctccacccctaccgccatgtctgccctcctctaggaatgcaggaccgtctgactgtatcctcagccttcaggtcaagcacatgatctgtttaaaaatggaaaccctcctatccttcagtagtgaacaagggcgactctggttgcttttggaaaattcagctgctttagtccaacagttcaggagaggatcagcataagaacttggtgatgattactagagaaaatgctcctatgatttcctgagcataatatttccccttgcaatttttgagtgttctatagcaaacctgccaaaaatgtggagcctataaataggggagagtgggaagaaaaaaatgggacctctcacaatgccactgaaaacagggaactaaaaattttccagagatgcaaagtcaaagggggattaatatttacttagaaatgaagtagcaggtgcatgctttataaagaaaagccaagaaaggatgaaattaggggagagactgaaaaagatggaaaaatgtgccaactaaagtctcattttgaagaaagttacagatcaacaaagggggaaaaactcaggtaaaaagactccatattatgtcttgcattgattaggcaggtgctttatatgcacttttaaattttctcttcctgcaaatactatgaaataagtatcactaccagagatgacattcaaatatttaacagcagacaaatatttaacagcacagacactagccaatcagaagctggctagaggagccccgctaagccaggcagtaaccctctaatggctggatcatgaggccaaggtaggggtcagggcagcagcagattctgtacagaggccattcaccaacctttgagatgttgcaatatttaccaagtagcacagctgaaatactgtgtgccagttgaacatcagctctgagtggaaacccagggccatgtcctctgggcaggtgtaggctttctctcttgcgtttgtcctctgtagattatgatgctagcattgaagtctttcttgttgcgcctggctgtggtggtctgcaccactatctgtgtctccaagccgcagcccactccatggggtcctgatggttcccttctgaatctagggaggacagcaggcagcagggaccctccatcgctgttgccacttaatccctttagcatcctcaagataagcccagtctgtacaaattcaggttcattttatttctaaagtcccaggaacaatgtcagaagggaattacagtgaagaaagaaagagttcaagttccagcttacctagacttcctgcagagcctcgaaagagaaggcagggttgcagacatctttgtttcatctgtccagcatcctctcccgtgccttggtactgggctttgaagccaggctgcctgggtttgcaacttgccacttattaacagtgtgaccttgggataaaggcccacctttcagagccactatagattggttattggaattgctggttttgttaggtgttacaaaatgtcagggtttttttttcttcttttgatgcgtaaactgaggtattaggggataggaaatgatatggtgtttagaatttgctttaaaacatattccaataaaagggctggactcagtggttcatgcctgtaaacctagcactttgggaggctgaggcgggtggatcatctgaggtcgggggttcgagaccagcctgaccaacagggagaaacaccatctctactaaaagtacaaaattagccaggcatggtggcacatgcctgtaatcccagctactcgggaggctgaggcaggagaatcgcttgaacctgggaggtggaggttgcggtaagcagagatcatgccattgcactccagcatgtgtaacaacagtgaaactccgtctcaaaaaaaaatatatatatatgtatatatatatatatataaaacaacaaaaaaagaaggtctcgatgcggtgggtggggaagggcagaggagacaggttgatgatggttgaagcgaggtgctaagtacatagggtggggttcttgcgctctccacacttctgtgtacttgaaaattttcataacaagagaaaacaaaaaattaaacagaaaatgaggttttcatttcctccagcaaaacaaacataacagggacttaggatgtacttttcccaatcgctcctctggcagaatattttgatcctccagctagcttccagctcttatcctgttcatctgttctgtagatactggcaggaaataggctcttcaacagggcctgctaggtccagtgctagggagtagagcgttttggattctacgcctacatttttttttaagtgaccagttttctagttgagatacttgaaatacaaagtctcatggtgaggtcttaccctctgctgtcccattcctttttacaggccatcatggcgttaatcttatctccaaggagaaaaattgggaagagaggcctagattcctcaacagaagcgggaaggaaaggtttgcagaatgaagagtgtgaagtgaggtttgtggtttgaatcatccgaatgtcaaggagaaaagaagaaaaatgaatcatcatcatttgaccacggtatttacagctagcggaagggacaagaggagaaaaaagcaagggaggagataaaggaagaacgtctcagaataaaattggggtgggtggggggaggaggaggaagacagtctaagaaattggtttggttgcaccagtactggccacaacacaaaaatttgtccattcctggttgaaattaaaaataaatgtgcatgcacatgtatttgtctgctgtgtttaatcagatagcgaggcactcctttaagcaccttgaagacccaaagttgcgctcagaggctgcccacctggaacggagaccgaggttgagcagggagctactcagaggacccaaagccgcctagctgaccaccttcttccctatgagttcccagtaacggagcccagtggaggagacgctacacttctctgtggggacagaggctaagggcgggggtctccatagaggcgttagcgcccaccagcggcagtgaccgcgcacagggaggtgaagaatgcgaccacggtgatacgtccaacctggaaaacgggcctgagaaccaaagggccaacttctggccatgcataacgaagcagagcagtctcagggtagaaggcactggaaaagcgttgtaggacaatttttcccagtagaaacggtgggggtgggagggagacccgctcaccccttttgacccacccctgcagctcagccacgcctcctagggaggtgggcagccttgcaggagcccgcgcgaggctgcagtaccgccctccgccacatgagggcagcacggcctacccgtgcagcagcggcggcccccgcgcccctcttggccagagccaggcgcaggccggcttgcggtgccgtcgttcattggccgcggcgc

SEQ ID NO: 230 - DNA, 2270 bp, Homo sapien
agtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaaggtgggagagaccaggggccccgggagggaggcaaatgagcattgagaaattctgggacaggagctcggcgagaaaagaaggggcggaagttcaaatagctgccacttggagggtttctcttagactatggacgctgtctcctctcctttgccgtgaagcagcgcttgatccgccgcctgcttggaggctggtccctttccccgacgcacaccctggcttctcactctggctggggactcccacagagagggcagctctggcaggggcaggggccactgtgggactgggacgaaggagcgactccctagcgtcctgcaaggcaggcgcagcgtctcctattctaggctgcagaacccgagctgagtgtcagtcgggatgtgacatgaagcgtctggcctggtccctcttcctttcaagctttccccgtccctcgtggactcggtccccctgccccacatttcagaaggctccccttccccctccacgtggacacacggcctcctcccctccccccttggtctgtgggtctgcaaggagccctcgcgggaagcaggaaggagcggggtcgcggagcggtggacaagccggcgccgttgctccccgccctctccgtagagctgttccgggcgccggtgctgagggtgatgggtccgcgggaggcccgcggcgcggcgctgggtggggtggtgctgcgctgcgacacgcgcctgcacccgcagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggtgagtgcctgcacaccctcccggacgccgaccctggcggtcagccctgcttccgcctctcggcacccacgaatcacccccgccccctggttcccgtcccgccccccgcctttcccatctccccttcgccgccctcctcctcacccctcttccggccttccccatccccgcccaccgccctacgcccctcccccagcccagcgccgagaagaaccatgcaagccgcgcgtgactgggcgtaatgcattcacaggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctattt

SEQ ID NO: 231 - DNA, 10000 bp, Homo sapien
catggagtgggaaaataggaaaagaggcactgctggaagacagaagataaactgtattttgtggttttgtgtaagcctgccattgccttcatctagacctgccaagtgtgacagatttggacacactggaaaagttaacgttttcagtgggaagttctgggtttcagttccttctgtcagtttaggtatcatcagcatcatcattagaatcactaaggagtcagagaaaggtgtgtccacctaattcaagggcctgagtgccaggcagatttttccatggtagcatgttccatcctaacgatctcttcagccttgttcccatcctattctctttaataagaagttgtcattgtctagcaatgaatatttattgctcagagatttagcagatagtgaatattttcagacatcaaactaatttgcatttgtgcttgagaaatttttcccaggtggcacaatattttatatcctgttgtaactgagaaagttatcacatacataagaacacatttactttcattttatttttctcctacagtatatcctgttgtaactgagaaagttattacatacataagaacacatttactttcattttatttttctcctacagagcgtcctatatttctgtaaactggattacagggtacttagaagaacgagcttgcttgtcactgaagtatgcagcctcttaagtaaaatccaagccctatttcatcatcatgtttattctgagaatagaattgaagaggaccacatatggttgaaattatagggagggttgaggtgggcagaatctggcccagtggaatcatccaatttggaaataatccatgaaaactgtttggcagttttagccatgcccctgcttcccatcgcctaccccctgccccaacttccaaagagcatataaatttagtgttggtgatgaaaataggaagagagaactttgatttgcagttaacatgaaaggaaatatacactgttttagtccatctgggctgttattacgaaatactacaaactgtgtagcttataaacaacagaaatttatttttcacagttctggagtttggaagattctgtgtctggaggcgctggcgtatttagtgtctggtgaaggccccctttcacatacgtgttgcctcctctctgtgtcctcatgtggtagaagaagctagctagttcactgggctctcttttataagggccctcatctcatccatgagggatctacccttacttatgaactaattacctcccgaagaccctgcctcctaatcccatccccttaagggttaggattccagcatatgcattttgaggagacgtaggtattcagtccattgtgcacaccaaattatgaattaatgtattaatatataattgtatccaaagaaaggtctaccaggaacccatatttgtttgctgatttgcttgtttaatatgcttcatttcctcaaaacaaagggaagcatattttagcttattttcctttttaatcttttgttttgagaatctctgccattgctaaagtagaaaattatgttttcttaactttttgtttattatacgtaaatacattattattaataatataaattcagtgtgtatgtatttctctatagtgaaggtgttgctttttaagtgaatgtggctataaactgagactttaaaaaatctcattgtcattaaaaaaatactgatttagaaaagttctagattcactgtatagaactcacagaatatagaatagttgctagagcacagaaactagtactcttttaacttctaagaaaaagtctgggaataatgtagatcccctcatctttatttaagtaatcaaaattgattctgtgctgggcgcgatggctcatgtttgtaatcctagcactttgggaggccaaggtgaatggattgtctgagctcaggagtttgagatcagcctgggcaacacggtgaaacaccgcctctactaaaatacaaaaagttagccaggtgtggtggcaggcacctgtagtcccagctactcagaaggctgaggcatgagaattacttgaacccgggattcagaggttgcagtgacccaagatcactccacagcactctagtctgggggacagagtgagactctgtctgcaaaaacaaacgaacaaacagaaaaatgattctgcataatgtggggcagattatttatttacaaaattattttttaggaaagaaaaagttgattactaagatttagctagattcactatgatcaagtcatggagtcaaactttacgttgttgttgtttgcatgagttaattggctgatagattactggaaagtcatggatgttgtgtatctggtttttagcaagatgtgcatcagtgttccctataatgtctttatcaatgagtatgagggctgtaagctgagtgataattttgttaggcagatctttggctgtttgaataatcaactgtagcaatgttattcattaatgccaatttgatgaaaactttggtctggttcaatatgtttattaataaattcacagagaagcttaatagcatactaatacaatttgaggatattagaaactaggagggttagttcctatcttgaataagaaggcagatccaagaactccacagaaataaactatggagaataacagttatttaattttttcaaattatggatgtggaggaagaaatgaattaactctgaaatgagagcaagacataggactaacagatggaagtttcaggaaaatatattttggctcagtaaaagaaataaattactaagatttatagtagtctgaaactgaaattgagaatttttcaggagatactcaactattgatgtgaataggtgtcccagcaacaattggacaagcccaccgaccacttggtgacattttccactaggcattcagcatcagattccacagcgcttttgaggtggaggataagtagataatatgtctccattatttagaggaaatctctcacctttgaactcttacagaactttaagtcatttaataattattcctgtgtaatgtacaggaataattatatatattataaatatatatgttttatatatggtacatatatttatatatatatatgtgtctatatcctatccctttaagttcttttgatagagacatgtcagtcatcataggcttatagtgcctagcataatatcttgcacatcaaaagagaaaatagtgaatgaatgaatgaatgatttctataacaatatattttcttccctaggtgaaggacatcctaaattcttgaggatactgtgtatgccctgtgttataatagcatggtgcacaccacactagcccttcaggtgttcttgttctctttttgaatgctggtaccctcaatttattattcttgtttggatatatccaatttaccttgttgaacattatttactaacagcaatctgttagccactaggaatgtaaagacacatcataatatgaccttctgagggacaaaaattgaggcctatttatctttgtatcccaaatgcctggtgtacagctggttctcataaaatgttgaattgctcccggaccagactttagagtttggttttaaaagaaaagccagagttcagcaacagcgaagggaatttaatgtggagaaagaaacatgaaccaagaggcacagcttagtgttgctgagatcaggtaaagcatccctgtgactggggcataaggtgtggcagggatgagagggcaagaaagagtggcacaaaagtgcttgcaatcacagcagggactatcaagtaagggccttgagtgttgtgccaaacgactgtggaggttgaatttaatctcatggacatctctagactattctactttagagcaactctaacctgtatgaacatcttccagttgctggatcattttctttagggatttttggagggggtggggagaatctcagggaagcattcatatgtcaagcaaagtgacctagacttcagatttacactggaggcttcacggtaccaggtgttgaaatcacacattctttggcacagaagctagcattctcatttgtgcatacagtttatgtctcgattattctttcagttgtttaaaggtctgggatagatgcatttagccaacgagttatgttattgtgtctgccctttggaaactttactttgtaggaaagccttactgcttagaatgttcagagaagctgaggttatggggcaagtgacaggtctcttttctgaggcagctgccacactctcttagtctaagtggattcttcctgaaatttgcttccccaagtgactacttgtactggttatgcagttggttaattttaaattgatgtcagcatttgcagctaagttgatttggaaagctctctaatttaactcttcatatgtaatcctgtccccagatcatgatggtgataatttttactgcatctttagatttaaggtcatttaagtaaattgctttttgttgtcttcctacttatgggagaaagagagagagaggggagaccaagagagcactagtgagcatcaggtgtggtttttaggcatgtggagtttcttcttagaaaagttgctgctttcaattgcatgtacgatgtacatttaatatactgaagagttttgctttaggaattaagtaatcattttcctctgtgctgccacagtgatttacaccttcctgttaacctttcaatgcctcccactttgccgaagataatactccttccccagactaataaagccctacgtggcctggatcctgcttacattttctctatccctgttgtataaccacgctttgccctgtccagtctctggaacttgcactgtttctttccatcatgaccgttatgcagactgttcctttacctggagtgaaatgcacttttctacctttttccactactcactcccacctttcctttggatttcaactcaattagcattacctccaggaatcctaaccttgtctgtgtcaaatcctcttataagctcagatatcagtgacatgtttgtactggttggctataattttacattaatttttatgatgattttgttaatatgtctctcctccactaaaatgtagaaacctgtcaattttgttcagcaagggtctccatggtaaagcaccatacctggcagagaggaggtactcaaacattattttataaatgagtgaataaatgatatatttaaacccctttggaaactcatttcccagataagaaggtattggtcaatagtttgtctcacactgaataaatgttccgttgtccatgccagtaccaaactgactacttcttccagaaatttaaggactactattaggctgagagtcactttaaggttttaagaagtcaggtgacaagggtggaagtggtgaagctcagagctagataaccttaatttcagatcctcactctacaagtttgcttatgagcttttgtgaccactgaaatgtatcttagtctctccaagactcagtttccctaacacataaaaatgggactaaaagcttcagttcagaaatttagtaatgggccaggtgtggtggctcatgcctacaatcccagcaatttaggaggctgaggcaggtggatggtttgagcccaggagttcaagtctgacctgggaaacgtggcaaaactctttctctacaaaaaataaaaattagcctaacatggtggcatgcttctgtagtcccagctacttgggaagctgaggttggaggattgctggagcccaggaagtcgaggctgcagtgagccgtgtttgtgccactgcttctgtcagcctgggttacagggtgaggcgatctcaaaaaaaaaaaaaaaaaaaaaagaaaaagaaaaaagaaagaaaaagaaatttagcagtgtctatcaaaatttaaaatattcctaattttaactaagcaatatcacttgtaagtgctatttttcaacacgtacaaggatattctttacagcattattagtaataataaaaactagaaactaaatgttcagaaaactaactaagtaaatgaaagaacatttattcagtggccactaaagagaataaaaatgaattagttgtgggaaattagatatgggaacatgaattcgatataggtaaatgttcaagataccatgtgaaataaaatagtttcagaagggtatatgcacaaagagacatgcatagaggctttctgggagatactcaaagcattggcactaatgggtacctctgggaattttgatgagtgattcatatatgtgtgcataggggtagaagtatttacttttcacattatacttttacttactgttggtatttttaccaaaaagatgtagcactaatataattttttaaaaacctcatgaaatacaatattaccctcttatgtggttgtaagaattagatacactcgtgtgaaaaatgtctggtccatactaaagagttaaattcagttgtcccttagtatccatgggagataggttccaggacttcttacggatactgaaatccaaggatgctcaagtctttgacataaaatggcataaaatagtatttgcatataacttatgcacatcctaccatatactttaaatcatctctaaattacttataataatgaatgcaagtaaatgctatgtaaatagttgttatactgtattgcttaggaaatagtgactagaaaaaaaaaaagcctgcacatgttcagtacagatgcaatttttttttcaaatatatttgatccatgattggttaaatccacgaatgcagaacccatgaatgtggagggctggttgtaggcactttaaaggaaaaatatggtcatttttaagtgcacttgcagagagcttccaatttgaagcctcatgagtttcagctgtccccagtgccctggttactgtaaaccattaagtctggaattcacctctgcatgtcctagtcagctaggttggcttcagcccttcttgctgggagtgaaaagggagggagaagccctcgtttacttcaggaggtaaaaagactctaggctgagtctccaaagcctagattacagcaaacatgttttacgttaaaaattggggaagttaaattttagggggcaatccctggttactttcttactaaagttgtataatttcctacttaaaattaaaactcggaaacattactggcagtaagggaaggtaacatgagttttcaaaccaggtactgagcacattaaaatagacccagtcaaagctgcatacagcttcaatattcatgcaatattcagggtgtatattgccatgtcagagtgagcagccaaattgtgcgtttcagtctcatggctgtcccctgaggaggaggcctaacttttagtctcctcaaaacacagaccctctccactacaaagtgaatggtcattcctttgctgcttgaatctgggattctttttcttgtacttagggtgtacggaatttacctttctttggaatcatccttttttatggagttctgcatctgaacatgacctggccacgcatatgcacactgagtagttccatttcaaactagacgttctgttgagctcagaccattctggaattatttggcaacatctgaaacattttttttttttttttacctacaacacttctagatgtgatgttttctggagaattgataaactgatctggtagctgttagtggctaccaagccaagttttacattgcaatctaaatatattgttccttgtcatgtaatgacatttattagagaatctggcaaaagcccaaataaaaatacaggttttcacactgtttaacaatctgaggttttatgtctttttggtgaggtcattgaataccagtctcatttttactgcctctatttttgaaaacagtaaacagtcatatttttattgtcctacgtggttgcacaaactgacacattgccaagtggttctgactgaatgcttttcacttggcaaactaaaggtactaaaaagaggttcacagtggagacttatgcatgtaggggagcaatttctgtgggcatgtgtatgtacaaaataaatctgtgaattccagtagagccagtatccaggactctaaaagtagaacagactgatttatttgtgacaatgtacttcagctgaacctctgtgctagtttgttggcaaaacctaacatatggccttttaatgagagacagattaataattgcagatatgaataataaagcagaaagattggctgtgccatcttttattctaataaggaattagatttggttactgaaggagcagctgtttgccaggtatggtatgctactgtttgagatagacactttgatgcaaaatgggacgcttgatggtgatggacttgaaaaaatggatatgcgatgtgtgtttaaatttctcaagccctataacaataaacattttacaccccaatgattattattctataccaattgtcattcaaaaacctacaaaaaagacacagtgacaatgttttctgtcttgttgttctttgagagaaaagacctatgatggtacctcagtgcaatggaaaaaaaaattcttgacaaaaggatcaaatagaagtggtggcacagtttctggaatatatgacattatgtttaaaattgagtgcaaattcttgtcctcccctgtgctagacacgtttctttgcctgcttgaatccacagctccttcaatagaatcaacctgcccctaccttggctcctagaagtgtcagctgcacttatcaggtgacccatttccatttctagctatgattagttagtcagggatggagcctaatcaaaagggagctaacctattcattcaacagaggtaaagcagattatttctctcaagaatttgaacaaagtgggctcaaagactcaagatattcagtgatgagccccaaaactgcagtgcagtgtacaaaatgggctgtgtaggtgaccatgctgagaatatgcaagatacatatgcgcaagaatgtgaatggtagagatggaaagagcaggcaaagataagaacctggtggagaatgtagaagtagaattgagagagagctagaaggagcaatgttaggattgacattgtcactccggtttctctgagaccacgtttgacattgttgtattcacataataaccatctgtttacctaagctactttgagtgaattctattcctgtaaccaaaaaagtcttcatgagaacaccccattttacaatataatcctgtgtgcataactatgacttgagatctatttctacactgaaatctgcaatatgagattgttctaaggaaagcctctaaataaccaaaaagactagacaaccttcagtattagggtttaataaaaatagttagcattctgatatgggaaatgtattccagatggaatgttattaaggcttatcagtctagagtaaacatggatgtgtacaccaaattcttcagtatcagaaccagatggcactcaaaaaggtttaatttcattcaaataagcaatgccactttaccaactagaaaggggataaatgaaactcattacctcagtgtatggcttaggactcagataaatgcatgtgagagagatccttaataggtgattgagataaattagggaaatttaagaaatcttcttatacctttaagggagactagtgagaaagattttgctgtctaacaaaacattttcttgatgttagtattcgattccacaataagcggtatcttttattctagtgttctctgtgggtagtaggtatgaatttgccctgtgactctcaggtgtcttgttacattcttcttatgaatcagattattttctcaagagtctggagatcttatgtcatcctgaaaatgtagggaacggtctctttagcttatcagagttagaattgaaatgcatattttccaaattcatatggaccatatcaagttgggagcctgtttag

SEQ ID NO: 232 - DNA, 10000 bp, Homo sapien
tgcgggaaactcgagttggctcgagcttgccctgaagacgcgccacgccccctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatccgcgtggacaacgtccgcccgcgctgggacttcaccggcgccttctacttcgtgggcaccgtcgtttccaccataggtaagtgtgctggccggactcgctgacaacctccgggcggcctccacttcctccggggggcaggaccgaccctctcatcctttcattcatccatctgggcgcccagccagactccactgacatgagctgtcgcctgatcaacaggtggtattgcctccccgctgctctaatgtggtccaggcaccggcagcttcagcgtcacctggcagcttgttagaaatgcagtctcagtcccctctgcagacctgccgagtcagaatctgcatgttaacaaagtccccaaaggattggaatgatccttaaattggagacgctctgctctgggagattttcagtctaatgaaggagacacggcttgagttcatggggaagaaggcttttacagatagggacaggaaactaaacatttactgagtcagtcagaggggaagtgcagattttaaaagattctgccctcgacttcacacttaccgagaaaaaatcagaacagcagactgaaagtgaggaagcaaaagtgccaatgacggttcaaaagatggaaaattttccaccaggaagaaccagggaagtgacctttgggctgaatcaattcgtgttaggcataacttgggtttgggaactgaaagcgcggttgcactctagagtaggagagaatcgcactcaggggccccatgagctggttggagtggtggaaggaagactaggaaggtctgctggctaatgggatggaggcgggggtaggaccttcactgacagactgaggagctggaatttacctagaggcacctgggagccattgagaattttttagcaaagatgtagcacagctacaatcagctgtgtttatttcccagcagaaggaaaatgatttgggggagtctgcgccacacccctaaagattgttcatccttgaagaataatcaagtgattaatgggggttagggaagatgctgtagaaataaattctgaggggggcaaaaagagacctggagcaggggagggaggttggaagagttagacggagaggaagtggcctccaagctgcaaaaaaggctggcagttgcaaacagcccagggtgcatgtgctgagcgctctgtagctactgcccctgtgcactctagaagagctcgctggtgaggtggggcgacaagttgagcctccttgaggctcccacacatggctgtgctacatagacattctgccaggagaagcagcacaaaagacaaaagagattggcttcaggtcagattcatcatgaaagacttcccagggctagtccaggaatccagggcttcagctgatgcacaggaggcgaggcagaggaccagtatgattagggacacaccggctgtatctgaagtgcctggctcccagcccccatcccatcccagatggtgcggcccatcagcaggccatgatggcaccaccataactgggtatcaggcaggaaaccttgcagcagaccagaatgggcccaagattggtgaaggaggaataacacccccatggttctccccctgagcccacactatctgctggactcttagccgtgttccacaagcccctcctcacatcacctcccacgtcccagaagacagttccagaatctccacataggcaagacttgggatgaacaaactgattaggaggtgtcactttggaagtgaccttgactctactgtgtttgcatagcaagtacaggatttttttagattgaatggtaacttagggtggttttgatgggagatttgatggctgaatctttcccaccaccatgaaaaaccatctcttggtgctcccagtgggcacagaggcaggaaggagcagagtgtgtgtgtggacaggtgcatccatgtagcaggaactgagagtggcatgggtaggtggccatataggaacatgggctttggggatacgaatatgacaatgtggcatggaggagtggaaagaaacctggacaaagagtctggagtgggagcttttcatcctgcctctgtatcttgggcaagcctcttaactattccgagccccatccttttctcatctgaggcatctacagagtgcccaccttggtatctggcacatcagctatttggtgaatattagtcctgccccctgctccctccgtctgcgtaagcctgcccctgtcacagggttcttgtgagggacaatgagctcttgtaagtgcgtgcgtgttaaaaggtaaaaaacatgatgtcagtgtgggctgatttttatttctcatttgtaacatttccttttaaattgtttcactaattgttgtaataacagcactggctaacctttatcagacccgtattaggcacatactgtatgattattatgtgaatgtgcaatgcagctcattgctgtgtgacattcacacttcatttcagccaacacaactccatgaggtaggcataacactcccccgttatagatgaaaaagctgaaggttcaggttttttgtaaaataaagtataaagaagaaaaaaatcaagttatatgcagtaatatcatccaaattaaccattgttcatgttttggtccattttcttctggtctcctttttcctctgcgtatacttatatacatatgcatttttaaaaattagaattatattctataaaccactcatatcttgcatttttattgtaacattacatgatggtgtttttcctctaaaaattaattccaccatgctttattctgcaaagactttgaggtagcagacaaagtatacaggaaaataatcataaaatacaaataaaacttcagaaccagggaaaagaagaacagaaatacgggatgcaagtggagctacgaagttgctagagaggaactttgtcttagtttgggttcccttagaagcagagcttgagccaagaatttgagtgtaagcagtttgttgggaggagcaagggatacaggtcggtgcaagggaaagtgaatcgaggaaggaaagtaagttaatccaggatacgctattaaggcaggtgccacagtgggcaactggtacctaatcccaaatggaagcttggaagcaaagcaaagctcttgacccagatatcccatgcaagaaagctgggatgtttacacaaccacacctgtcaggaattggttaaaaagctgtctggggaggatgagaaaggagcacggggatgtaatttccaggtacttctggccttattttctttcatggacagcccaagggtagccctcacgcagagataggctctgctgttggaaatgaggccagtgtgccaggaaatgataacacgatcccaaggaatggtggggaatcccatggaaggcagagaaccagcaagcttcagatttggtttcaggcttcatggcagacagagtcatgacccatactagaattcttaatatcagaaacgaggaaacataaacctttccagtacctaattctccttttttgagacagagtcttgccctgtcacctaggcttgagtgcagtggcacaatcttggctcactgcaacccctgcctcccgggttcaagcagttctcctgcctcagcttcccaagtagctgggattacaggtgtgcaccaccaggcccagctaatttttgtattttttttttttttttagtggagatggggttttgacatgttggccaggctggtctgaaactcttgacctcaagtgatcctcctgtctcagcctcccaaagtgctgggattacaggtgtgacccactttttatttttttattttttgagggagtctcaatttgccacccaggatggagtgcagtggcatgagcttggctcactgcaacgtccgtgcctcccaggtgcaagcaattctcctgccttggcctcccaagtagctgggattacaggtgcaagccaccacacccagctaatttttgtatttttagtagagagagggctacaccatgttgatcaggctggtcttgaaatcctggtctcaagtgatccgcccacctcagcctcccaaagtgctgagattacaggtgtgagccactgcacctggccccagtacctaattctcaaaagtattttctctttgggattatatgtaggagacattgtgtaggacaacagatgatattcacaaacaatattttcctggaaaatgctattgaggatttcatgtagctgtgatctaattgagacttttgacttaaaagtcagagcttagagtgaaaaacagtttgccagtttctctacaggttaaacatagaactactttatgacccagcaattccatttctaggtatatatccaaaaaaaaatcaaaagtagggattcaaacagatatttgtacgccagtgttcatagcagcattattcacaatatccaaacaacccaagtgcccatcaacggatgaatgaattaaccaaatgtgggctacatacaatggaatatgattcagccaaaaaaaaaggaatgaaattggccaagcacggtggctcatgcctgtaatcccaacactttgggaggccaaggcaggtggatcacgaggtcaggagttcgagaccagcctggccaatatggtgaaaccctgtctctactaaaaataaacaaattagctgggtgtggtggcctgtgcctgtagtcccagctacttgggaggctgaggcaggagaattgctggaacctgggaggcagaggttgcagtgagctgagatcgcgccaatgcactccagcctgggtgacagagtgagaccatctcaagaaaaaaacgaaaaggaatgaaattttgatatatgctgtaacatagatggaccttgaaaataattatgcttagtaaaataagccagacacagaaggacaaatatcatatgattccatttatatgaggtacttagaataggcaaattcatagagataaattaaaatacaggttaccaggggctgagggacggccagaagtgggagttattgtttaatgggtactttcagtttgggatactgaaaacattttgggtatagatagtggtgatggttgtacaacattgcaattatatttaatgctattgaattgtacacttttaaatggttaaaatgataaatatgttaagtatatttgactgcagtaaagaaaacctcagggcagagtattaaaacacaattcagaaatgttgattctgaaaaaggctggagatcagacgtgaaacagggataaacttaaagtactcagaaaagtagaatgacagtatgtcttgtaaatgatcttctgtgaatatcttttctctgaaactagcttttgttaggagcttctccccgtgtttgctggtatatctgtaggtagcttctgtccccaaagggtttgaggtactctgcatttgacagagtcggggaaggcttaggttttgctgcagtaacaagctactcccaaaatctcagtagcttaatgtaataaaagtgtacttcttacccacaccaagttcactgtgggtgctggtgatgctgccgggcggttgtctctgtgttgccccagcgcttcaggcctcttctgtctcttggctcctcttcctcagcacatgcttccaggattgctctagaaggggaagaaagggctgaagagtcaagcaccaatgattaaatggccaccaccacctgcaagtagcacaggtcccctccactcccacatccttggccaaatcaagtcacagaaccaccactccctacttcaaagggtcagggaaacgttatcccatcccctttgtggcaagttgcagaagaaatgtttcttccaggctaaaaaagcacgtgttgggcccagcggggtggctcatgcctgtaatctcagcactttgggagggggaggtgggtggattgcttgaggccaggagttcgaaaccagcctggccaacatggcgaaaccccatctctacaaaaaaaatagaaaaaattagccaggtgtggtggtgcaggcctgtagtcccagctacttggcgggctgaggtaggaggatcacttgagcccaggagattgaggttgaggctgcagtgaaccatgatcatgccactgccctccagcctgggcaatagggcaagaccctgtctcaagcaaaaaaaagaaaagaaatgcagactctcaggtcaaccccagaccaacagaatcaaagtctgtgctttaataagacacccaggtgagtcctgggcacattcaagtttgagaaatctggagtctagagggccgttcatgttgtgatgtttctgactaggacaagccctcccatgctttagaacatagacaaactggtggccaggcaggtgtggtgaggaggtgagctcacctgctgtcttatgacctcctcgccaactggaagtcaagtgcgctgagggcaggttcattacacaccatccagatgcagggatgtgccgggctcaggctgagaagatgacccggctcatgaggacctgagatgctcagatggagaggctcagcctcgcctcgtatgtgactagattctcaacaacagtttttattcttttttttttttttttttttttttgagacagagtttccctttgtcactgaggctagagtgcagtggcgcgatcttggctcactgcaacctctgcctcccaggttcaagcgattctcttgcctcagcctcctgagtagctgggattacaggtgcctgccaccacacccagctaatttttgtatttttagtagagatgaggtttcaccatgttggtcaggctggtctcaaactcctgacctcgtgatctgcccacctcggcctcccaaagtgctgggattataggcatgagccactgcgcccagccctattcatttttattaaacagagataattatgcaagtgcccttttctgtcccggggtgtggcccatgattggctctgcatggctgtactctacaagacccccatgggattctggggctcagctggtaggtgtcttgttggccctggtcagtgtgtaaatccatgtggtgctgaactgaatattgctttggaaatcttttttttttttttctcagaggaacaaggctgaggaaagagcttttgaaatcaaagtatatcaagtccaaacaataaaatattgaaagtcactattttacagtataaagttataaactgacatcaaagaagatgaggcattcagaaagaataaaaaatatcccacgaatgcattaatgatatacattaatggatgttatgcatgggtcaagatttaaatcatacattgaacacttcagatgttaccaagcatttgtgcacaaaccttatgggataggcagggaagttattactaattccattttgcaagtaaggaacctgaggtgcagacagcatagatatcttgcttcagaccacacagctataaagtggcagagttagaattagaaccaagttttgttttgttcagtgtctagtgacaaaatatatattaattttggaagactgggaaagtataaaaaaaaagtagaaatcatccataattctaccaaccaacaacaaacactgtaaatagtctgggaaatcatatcatacatattgaacctaaagtgctatttttaaaatctaagctgcatcattattttatgtaccatcaagaaagaaacactgccaattaaattctgacatgttacctgttgtgggatgcatctcgatttcagagatattaaaatttgggggaaaggtgtatcttaaaatcactgaaatgtattttgtatctcattgctttctatataaccattataacatgagcagattgttgtaattaggcaaaaatgaatctccttataattaatagctctgattttctattaaagttgattgattcaaaatgttgattaaaaaatacttacagttcatcttctctgaatcaactaattcttcccccatttttctgctgggagcagggggaatgctgtgttaatcaaagtgtctgtgtgctttatagtttaaagatttcgaccctgtctaaagactgaatgtgtcatatttttcatcctttattctctgctcaatgtctataatttattatttattacttagatagagaaatgtttttcatttcaattcagtttcgtatttcagtcctttccttgtgctttcttccattgtcttcgtgcttaaatctttttccatccagattccgtaagaatgcaagcttttcttcaatatttttgcaactgctctccgtttccagttatagcagtggcttttaaagcactttaatgtgttgtttcatgcgaacaatggcaggtgcgtttggaattatagctgaggagcaatgtgtggtcgtggggaatgagaaaactggaagagtagctggtgagagcttacctccactcaggatagggtgagagggccatacctcttccagcttctaaaatttcgtggggaagctcagacagtccattctgagaatcctggatttgttcaattatttgtttcctgctgggaacatttcaatatctggaaattagagctgtgttgtaggacacagccctcactctccattgcccagcatttagtattcatatatgctcatcttagcccattgcattagaaattcttgtttatattataaaatagaatggcttccttttcttttatcgtaaattccatccagttctctctttccctctatccctttctctatgaaggagagatgggtttggtatgagtgttaacccaaataattcttgggctccttggggtcctgtccaagaagctgtcttcttttgaaagaagcatggtctgttagccacaaataatgaaaaataaatttgatttttgcttgcatcttaaaagaaccttaaagagtctccaatttataaccaaagaaacttcttccttttctcctctcccagtctctcatatctcaaaggagttctggaacctcttatccctaaactcctccccaactttctcccaaccatcagccctctgtctttctgtccctcctggtcccatctccccacatctctctgtgctccctgttatcaggattgacttcacttctgcaacatcatttagctttctctcagcatatttcctggattccccacagtaaaggacagtcctggtagttgacccagcaagcaacaatcttttccccttagaaggaaggagagaattgggaggccaaggtgggcagatcatgaggtcaggagatcaagaccattgtggccaacatggtgaaaccctgtctctactaaaaatacaaaaaattagctgggtgtg

SEQ ID NO: 233 - DNA, 10000 bp, Homo sapien
cctggatggagacactggcttaatacgcagttctacttcggcgaccttaacttgctgcatggtgcacccatggtttgccaggtagtgttccaagaaataaggacgcagagatgaagaaaacaaaagtgctctcaaccttctcggggctttccaattacagcaagtgttttctgtagaagaccagagaataaataattgaggctttgcaagccatgtggtcgtaactactcaactctgctatggtagcatggaagtacaatcaacagtacataaatgactaggcgtgactatgttctaataaaactttgtttaccaaagcaggtggtggctgaatttgacccacagacagtagtttgctgaccccaagtctagaaagccactaaatacatacatagtaaataactacagttacaggagcctgctctgtgtcaaatactgttctaaatgctttacagatgtttactcactttatcctcactaaacccctctgagctagtagtagtatgcccactttacagatgaaaaaactaaagcacagaaaggttaataacttagccaaggtcacacaagcagcaaataggatgcgccagattttgaacccagcagctccagagtctgcgtatgtgagtattgcaccagctcccccatgctgtactgcctctcaaaaagtatacatggcaaattgtggctgatgctaggaagaaaaagaagatggcctgagagagaatagcaggtggacctactttagatgggctaatcagagacagctgagcttgagcaggagactgtgccatcgggaaactagtagtggaaaaagaataatattccaggctggatccattttctattgctgtggtgcaaattaccataaccttagcagctcaaaacaacataaatatgttatcttgtagttctacaggtcagactccagggaagctcccttggtttttctgttctaggtcttagaaggccaaaatcaaagtgccaaactggccagcctcttatctgaagcctctgggaagaatcagctaccaagcttattcagaattgtgccaggtgcggtggctcatgcctgtaatcccagcattttgggaggctaaagcaggcagatcacatgagtgcaggagttcgagactagcctgggcaacatggcaaaaccccatctctacaaaaaagtataaaaattagctgggtgtagtggcacacgcctgtggtaccagctactctggaggctgaggtgggcggatcacctgagccaaggaggtcgacgctgcagtgagccaagattgcgcctctgcacttcagcccagacaggaaggggaaagggaaggggaaggggaaggggggaaggattgcttgtggccgcagagctgagtctggtttcctcactggttgtgagggactctccactcccgaggctgcctgtacccctcaccaggtgtcccctctatctcgaaccagctatcgtgcctgagtccttctcaggctcctaatctcattgacttctttctactctgcctccagctggagaaacttctctgctattaagggttcatgtgattaagtggacccatctggataagagaggcttctctagattaaagtctgtagcattaatgacatctgcaaagtcccttctgctatgccacattagatgtcacaggttatggggattagggcatggacattcctgggggccctgaggaaaccacaagtgcaaaggccttggcatagaatggaaataaggctagtgtggctagatgggagagcaaggaaagagccaggcagggccaagctgaagaggtggcaagggctggctgctccaaggaggccttgcaggttgtgacacaaagtgagcttttgtcctaagtgctatgggaagctgtgaaaagctggtacacaggagaaatattatccgattcacattttttaatgattagctgctgaggagataatagatggggcctggtgggggccaattaagtgggtcactgcagcggtccagatgcaaggtggtggtggcctgagatgatggtagcagtggagctggagggaaggaggagatttgaaacacagttgtggaggagacttgtttgcagatgagatgcaggttgtgaagaaaggaaagatgataagagtaagaaggaaagacttttgggagagcagatgtagggctgaagattaagagttcagccttggacatgcactgccaagatggctattcaatatccaggcagtgctataaagtaggcagatacagtcatctcttagtatctgctggggattggttccaggacaccccgcggacaccaaaatccacagatgctcaagtcctttataccaaatggcatagtatttacgtataaactacatacgtcctcccatttactttaaatcatctctagattacttataatacctaatacaatgtcaatgctatgtaaattgttgttgtactgtattgtttaggaaacaatgacaagaaaaagactgtacatgttcagtacagacataaacatccttttttaaaaaaatattttcaatccttggttggttgcaaccactgatgctgaacctatggacatggagggtcgattgcatattatttgggaggcaagtaggtgccacaggttatgctcatgccaaaaaaaaatttcagccaatttttgtcactgacttcatttgtttggattaaggttttcaggctccagaaggatgctactgagtggccagcaaagtgttgcacactcacatgacacaactgctcagttgattggatctgcaagtgctctcattaggaggttgggaacctggagggaagagagagacacgggaaggggcaggggcactgttgatgatgaaagacaagcctagggcaggtcctgggaggtggggcctgagcagggaggcatctcaggaggacactgtcaattagggcctgcatgaaagatctgaaccaaatcacctttgctaaacccaaatccctgactgcagaaacaaagtcctcaattaaagagaagcacagagatttctgtgaggtgattgtcaaccaacagagggacagaatactggcttagacagaatccatatccaccttttggcatgcccaaagatacatgcccaggttccctgcaggatgcctcaggcctgatcaaagaagtcagcgtgacttggcacaggcctcagcatgcagaagtgtccaggtgagcagcaaagcttttattacagttcctaagaattatttgctctggatctcttctccacctgaagatttctatgtgccatttcttgcaagtttccttccttttggcctggtgcaaactcaagggccaaaactgcctggctttgtattccagctgtaccttttactaggaaacctcaggaaagtcagatttatctgttcctcagatgtctcatctataaaacggagatgctaacactagtacaggcatgcctcattttgttgtgcttcactttattatacttcacagatgttacattttttttcacaaattgaagatttgaggctaccctgtaccaagcaattctatcagtgccatttttttcaaacagcatgtgttcacttcatgtctctgtgccacattttggtgcttctcacaatatttcaaactttttttattattatgtctgctagtgtgatcagcggtctttgatgttactattgtaattgtttcggagtaccacaaaccacaaccatagcaagatagtgcataaaggtcaactctgtgagctttaattcaagaaggaaaatgggaatccaccagaaccgtgaaggacaccccaaatcccagggaggagaactcataaacagcccctgtgatggcatccagctgataaaagtaagtgaagccccggtacatgagcgaagcaaagaacctccctctgtgactcacctttccactgggtgtgcgaggagctggggctgagggagagcactttgtttctcgcaagccctggagcgaacttggagagaggcttggagatgctgtgaaagaaagacaccaggaaaagctgcaatcatttccccagacctgggactcagaggaggatactcttttaaatccagacaaatacaaagtcaaccattctttggtgacccagccgtgtggccatgcaggcattttagtctagggccagggattgaagtacttgctctggaggggggtaagggcctctacagccagaactatagaaagctcctcagaagtaggtaccagaattgtgctgtcccccatcacaggcctggggcaattggagagctgctacagctgcaggttttcctaggtgacaagacttgcagccttggcgacctagaaacaatctgcatgtgccagggtgtcccagcctgctgctctcctgagattgtggtacagtgggaccctctctgctccaccccctgccccccggcataaatccaggtattcagagaacccgctcactaggaccagaatcctgacatgccccacccttcatggacacagatcatggtgcaatgggaccctttccgctccacatccaggcagatctccggaggcattcagagcacctgttcacctagaatagcagcctgagctgccccaccctttctgtgcagagatcctagtgcagagtggccctctctgctccacatctgggaagatctgcaggcatctggagcacccactttcttggattaggagtttaggccaccacattcccgtccagagaacttgggaccaagaatgtttcctagctccaggcctagacacacctctggtcacttggtggccacccaactggattctccctcggtgctggtgcttgtgcctgtcattagtggacttataagcagacgtgctaagtccagctccacctatcttgcactcccctcccgcaaccctgggggataagcagggagctcagacctcttgtgtactccacacatcaggccattgcctgaagcaacagagagcttttcccagtaagcaaatatcaaatatacactcagctatgttgcccacagttgcctcttacctataagcacaatctactggcttgcaggtagaacgacacagcctattaaaaaccctatcaacagaaatgcataggaatatagaaacaaaccagaaagatcctacccagcattttctactgtaacaacccctagggaggagggcaaagagtaagggaaaaccctcgatgataatataaggaaagaaagagaaacaaaaaaaaaaatctacccaaaagaaaataattacaaaaatataaagtgtaagtgtctctggatgaaagggaaccagcacaataattctggcaccatgaataatctgaatatagtgacaacacaaaagtaccatgccagctctccaacagtgatccctaactaaaatggaaatgcaaaaatgacagatgaagaattcaaagcatggattgcaaggaagcccaacaagatgcaagacaaagttgacacaaagaaacttctaaagcaatccaggaaatgaaggaagaaataaacaccttaaaaagaaatcaatcggagcttctggaattgaaaaactcacttaaggaatttcaaaatacaattaaaacagtatcaatacactggaccaagcagaagaaagaatttcagaacctgaagaccagtctttcaaactaacctagtcaaacaaaaataaagaaaagggaactttaaaaaatgaacaaagtctttgagaaatatgggattatgtaaatcaaccaaacctacaaattattggcgttcctgagagagacaaaggaaaagaaaacaacctggaaaacatatttgagggactaattcatgaaaatttccctaatcttgctagagaggtagacatccaatacaaaaaatccagagaacacctgagagatactatacaaaatgagtaccacgaaagcatatagtcagtcaccagactgtccagggtcaacaataaacaaaaaattttaaaggcacctagagaaaaaggtcaggtcatgtacaaagggaatgcatctggttaacggaagacttctcagcagaaaccttatgagccaggagagattgggagcctattttcagcattctaaaagaaaagaaattccaaccaagagtttcataaactgccaaattaaacttcataagtgaaggagaaataaaatgttttctagataagcaaacactaaggaaattagttaccacaggataagccttacaagagatccttaagggggctctaaaaatgaaaaaaacagaacaatattactaccacaaaaacatacttaagtacatagcccacagactctatggaggaactacatgatagaaactacaaagcaaccagcaaaaaatgtcacaataggatcaaagcctcacacataaatattaacgtgaattagtattggatgtaatgaatgtaaatagtctatatgttccacataaaaggaacagaggggttaagttggatttttttaaaaagacccatccatctactgtcttcaaaagactcatcatgtaaaaacacccataggctcaaagtaaagggttgcagaaaaatctaccatgcaaatggaaaaaaacaaaaaaagcaagggtcttacatattcttaaattagataaaacaaactttaaaccaacaacagtaaaaaaagtaaaaaacagttaaaaaaaaaaaaggacaaagaagggtattacgtaacaataaaggattcaattcgacaagacttaactgtgctaaatgtatacacacccaacattggagcacccagattcataaaataagtgtgtctacacctacaaaatgacttacacagccacacaataatagtggggaacttcaacaccccactgatagtatgagatcatcaaggcaggaaactaacaaagaaattctggacttaaattcaacatttgaccaattggacctgatagacatctgtagactacttcacccatcaaccacggaacacacattcttctcaccttcacatacaacacactccaagattgaccccattgtttggccataaagcaagtttcaattaatttaaaaaaaaatcaagtcacaccaaccatacccttggacaacaatggaacaaaaatagaaatcaatatcaagaagatctctcaaaaccacacaattatatggaaattacaaactatctcctgaatgacttttgggtaagcaatgaaattagaagagaaatcaaaaattatttaatataaattaaaacaggaaaaacatactaaaaatctttgggatgcaacaaaagcagtgttcagaggaaagtttatagtgctaaacacctacctcaaaaacttagaaagattgaaaattaattatctaacatcacactataggaactagaaaaacaagaacaaactaaccccaaagcaggcagaaggaaaaaaaataactaaaatcagagctgaactgaatgaaattgagatccaaaaatccatacaaataatcaactataccaaaagttggttttttgaaaggatgaacaagattaataggcccttgtattagttcattctcatgctgctaataaagacacacccaagactgggtaatttataaaggaaaaaggtttaattgactcacagtttagcatggctgaggaggcctcaggaaacttacaatcatggtggaaggggaagaaactatgtccttcttcacggggcggcagaacagagaagtgcccagcaaaaggaggaaacctccttataaaaccgtcagatctcataagacttatttgctatcacgagaacagcgtgagggtaactgcgcccatgattaaattacctcccaccaggaacctcccacaacacatggggattatgtgagctacaagtcaaggtaagatttgggtggggacacagccaaaccatatcagccctagctagattaacaaagaaaaaagacaagatgccaataagcacaaccagaaatgacaacagtgatattacaaccaatcccacagaaatacaaaaggtcctcagagactattatgaacacctctatgcacacaaactagaaaatctagaggaaatagataaattcttagaaacacaaaatctcccaagattgaattaggaagaaattgcaaccctgaacagactgatatttagttttgaaattggatctacaatttaagaaaacctaccaaccagaaaagaagccctagacaagatgtattcatagccaaattctaccagatgtgcaaagaaaagctggtaccaaatcctactgaaactattccataacctcaaagaggagggagtcctccctaactcattctatgaagccagcataatcctgataccaaaacctggcaaagacataatgaaaaaagaaaattacaggccaatatccctgataaacatagatgcaaaaatcctcaacaaaatacaagtagacagcatccaacagtacatcaaaaagtcaaagaggcttttggtctttggtcaaagaggcttcattcccgggatgcaaggttggttcaacatattcaaatcaataaatgtgattcaccatataaacagaattaaaactattattaattattgtttattaaaacatatgctcatctcaatagacagaaaaagcttttgacaaaatccaacattccttcatgaaaaaaccttccagaaagtaggcattgaagaaacataccacaaaataggaagaaacataccacaaaatagtaagaaccatctatgacaaacccatagccaacatcatactgaatgggcaaaaagcggaagcattccccttgagaacgaaaaaagacaaggatgcccactctcgccactcctattcaacatagtactggaattcctcaccagggcaatcaggcaaaagaaagaaataaaagcatccaaagaggaaaagaagaagtcatgctatctctcttcactgatgatatgattccatacgaagaaaaccctaaagactccaccaaatggctcccagaactgataaacaacttcagtaaagtttcgggatacaaaaatcaatgtacaaaaatcagtaacaactctatacaccaataacattcaaactgacagccaaataaagaatgtaatctcatttataatagttaccaaaaaaatacctggaaatacatctaaccagagagataaaagatttccgaaaggagaaccataagacactgataaaaagaaagcatagacgaccaggcatggtggctcatgactataatcctagcattttggaaggccaaggcggatggatcacttaaggccaggaattctagaccagcctgaccaacacaacaaaaacctgtctctagcaaaaaatacaaaaactagctgggtgcagtggtgcacaactgtagtcccagctacactgagggacactgaggcaggagaaacatttgaaccccagaggcagatgttgcagtgagccaagattgtgccactgtactccagcctgggcaatagagtgagattctatcaaaaaaagaaaagaaaagacaaaaaaaggacaggacaggacaggacaggacaggacaggaaggaaaggaaaggaaaggaaggaaaggaaagggcagagcagacaatacaaacaaatcgaaaaaaattccatgcttatgacaggaagaattaatatcattaaaatggccatattgcccaaagcaatctatagattcaatgttattcctatcaaactaccaatattatttttcacagaactaaaaaaaaaagttattctaaaatttacatggaactaaaaacaaaccagaatagccaaagcaatcctaagtaaaaagaacaaagctggaggcatcacattacccaatttcaaactatactataaggctacagtaaccaaaatggcaaggtactggcacaaaaaaaggcacatagaccaatggaacagaatagagaaccccaaaataaaccacaaacctacagccatctgatatttgacaaagtggacaaaaataagcaagtgggggaaaagactattca

SEQ ID NO: 234 - DNA, 934 bp, Homo sapien
aatggggggaaatcagacttccatcacagagttcctcctactgggatttcccattggcccaaggattcagatgctcctctttgggctcttctccctgttctacatcttcattctgttggggaacgggacaatcctggggctcatctcactggactccagactccacacccccatgtacttcttcctctcacacctggcggtcgtcgacatcgcctgtgcttgcaacacggtgccccagatgctggtgaacctcctgcatccagccaagcccatctcctttgctggctgcatgacccagatgtttctgtttttgagttttgcacatacagaatgtctcctcctggtggtgatgtcctatgatcggtacgtggccatctgccaccctctccgatattctaccatcatgacctggaaagtctgcatcactttggcattgacttcctggattttaggagtcttattggcccttgtccatctagtgttactgctaccactgtccttctgtggaccccagaaacttaatcactttttctgtgaaattatggctgttctcaaacttgcctgtgcggatacccacattaatgaggtaatggttttggcaggggcagtgtctgtgctggtgggacccttcttttccactgtaatatcttatgttcatattctatgtgccattctaaagatccagtcaggagaggggtgccagaaagccttctccatctgctcctcccacctctgtgtggttggactcttttatggcacagccatcatcatgtatgttgagccccagtatgagagccccaaggagcagaagaaatatctcctgctgtttcacagcctcttcaatcccatgcttaatcccctaatttatagtcttaggaacaaggaagtccaaggtactctaaagaggatgcttgaaaagaagagaacttcatga

SEQ ID NO: 235 - DNA, 10000 bp, Homo sapien
cagctctcccgaagccgcgggtctccggccggcggcggcggcggcggcggcggcggcgcaggtgagcagggcagggggcagccgagggagcgcggggagcgggggccggggggccacgtacgaggggctgcaggcccagccggggcgggactcgccaatcctgcgtccccagctcaggacgcggacgctgatccgaagcccctggccccggctgggtcagcactgggagagcaggcccaggtccgcagcccgggtgtggggccctccccaaatccagggaagggatcgtggagcggggtggggactgaaagccatttccttcccgtgaagaatttttattagtgcaagtaacaaatatttcccaggcagcagttgtggggcggggtctagtggaagacgaataggcctagtggcttgacacatggaaaatacggaggcctgaaatactcatagactggctgaacaatctttggctaaaaatctcttacgtggagagttgcagtagtttcccaattgcctggccgcagttcctgttcccactccgtatcctcacccctgaacctccaccccctacctcttctccacacctcagcatctggaatgttcctttaagtaagaaccagactctcccctgctccgaccttccccgtagctttcctgtctcatcagaatcctataaacatttattaaggctcacaggcaaggcccctcgcaccccctactccggccacgctggcttccttgctgttcctggtgcacagccaagcatcctccagcctctaggcctttgcactgcctgtttcttctttctggaaagcttcttccccagataactgcatggggaaatccctcccttatcctgcactgcttcccatgccagcttatcagagcagccttcctcaaacaacctgcctatacaagaaaccccgctctgcccttgctgttcccccttccactacttcggttgtcaacatagtagttatcacctggtgacattttctttcttttcttttcttttctttttttttttgagacagattctcactctgtcgccaggctggaatgcagtggcacgatctgggctcactgcaacctctgcctctcaggttcaagcgattttcctgcctcagcctcccaagtagctgggactacaggtgcccgccagcacagccaactaatttttttatttttagtagagacagggtttcaccatgttggccaggctgtatgtagtctgctggaaaggaagtggaggcatagccaaaataatttctgggcattagtaagatggacaaatattattttttagtgattatgatggaggtttcttccagatgagtgaataagatgtagaatctgctccccaaagagctcactaattagtttaaaaagcagtcagggctgtgttgaaggttgggcaaggtggagtggcaagcccatactagctgaccctccagcatcaaagaaggctgtgttgatcctgatagatgagtggatattggtgggtacagagagaatgcagatattgcactataagtgtagagaaaagcaggtgacaagtcctggatggggtatctggagatattttggtactcactcattcattattgagcctggtcccttacctgtagtaattcatgctctattttggaaaatagttaaataagcaattttaataaaggggatgagcactgtggaagagcctgtgaaggagtgtctgggattttgagctgaaatctgtaggaagtagaaattgaccaggccaagacagcagaaggaatagagtcaagggcattttaggagggagcaggttggacagaggcagttgggagttcaggagagagtccatggtggaagcgtgcttttgagaaccatcattgtgtccgtggaatttaaagccacaaacctggaggtgatcaccaggggagtgagtccaagtagaaaagagcaagtctaaggaccgggcccagtgatgctagaatatctagaaaaggggaagttagaaccatagaaaaggttaaaaaaaaaaaaatagaagaaaagaagttgaagatgaaccaggaaaggagacagaaaaggagtagcttgtcagaacagaagaaaaccaggcccaggtgccatggctcatgcctgtaatcgcagcactttgggaggccaaggtgggtggatcacctgaggtcaggagtttgagaccagcctggccaacatggggaaaccccgtctctactaaaaatataaaaaattagccgggcgtggtggtgggcccctgtaatcccagctacttggaatgctgaggcaggagaatcgcttgaacccgggaggcagaggttgcagcgagccgagatgccaccatcacgctccagcctgggcaacaagagcgaaactctgtctcaaaagaagaaaactaggagagtgggtgtcttaaaagtccaagctaagacagggagaggagggcgaagaggatgcgcaaccccatcaaatgctggttgtaagtcaagtagagaaggactaagaactgactactggatttagtgatagggaagccattggtaacctcgacaaaaacaatttcagtggcttgtggagactgcatgattgaattgatgtttttttgtttgtttgttttgtttttgtttttttttttgagacggagtttcgctcttgttgcccaggctggagtgcaatggcacgatctcagctcaccgcaacctccacctcctgggttcaagcgattctccttcctcagcatcccgagtagctgggattacaggcatgtgccaccaccccggctaattttgtatttttagtagagatggggtttctccatgttggtcaggctggtcttgaagtcccgacctcaggtgatctgcccgccttggcctcccaaagtgctgggattacaggtgtgagccaccgcgcctggccactgaattgatgttttaaaaagatcatgatgtggctgtattaaaaaagaaaacagataataacaagtgatggtgaggatgtggagaaattagaaccctcgtgcattgctggtggaaatgtaacatgggtgtaaccactgtggaaaacaatttggtgattcatcacaaagttaaacagaattatcatgtgattcaattccacttatataccacaaatattcagaagtagggacttaaacagatatatgtataccagtgttcacagcagcatgattcaagatggccaaaaggttgaaataaccagtgtccattcataaatgaatgcatgaacaaaatatggtatatatacacaacggaatattattcagccttaaaaaggaaaggaattctgacatatgctacaacatagatgaaccttgaagacattttgctaagtgaaataaccagacacaaaaggacaaatactgtttgattccacttatatgaggtacctagaacaggcaaatttacagagacagaaaagagattagaaaatataaaaaattaaccaggcatgcccacacctatggtcccagctactcgggaggctgaggtgggaggatcgcttgagcccagagttcaaggctgcagtaagctgtgatcacaccactgcactccagcctgggcaacagagcgagaccctgtctcaaaaaaaaaaaaaaaaaaaaaaaaagattagcagagactgaaaggactgggaaatggggagttactgtttaatgggtacacactttctgtttggaaagattaagagttgtggatgtggatgtggtggcggctacacaacattgtgaatgtacttaaaggcagggaattaatacattgaaaaatagtacatttcatgttatgtgtattttatcacaattttaaaacataaaaaaaaaaatcacaatggttgcagggtagagaaggaattgaagtagctgtcggaactggttctgagattctcacagcaatccaggaatgaggtggtgttggcttgaactaggatggtaagtgtagacatctttgagaagtagaaagattttggtgacaggacttagttatagattagaaggcagggagaggaaatgtcaaggatgcctcccagattgatggctttcagacttggatagatggtggactcatttcctgtgaaaggaaacttcaaaccagcttgggagaagatcatacatgcagtacaggatattttgagtttaaagttcgttcaagatgttcaagtggagaatttggatagagagatctgaaactcagagcggttcataaggaatatgtaaactttagaggtaatggcgtatagatgatcactgaaatcatggacgtgaaagaaatcaccttaaggagaaagtatagagtgaagagaagaggattgttgggccatgccagcatttagagctacaaagattaaggtgtgttaaaaagagtggcccggccaggcgtggtggcccacacctgtaatcccagcactttgggaggctgaggctggtggatcactggagttcaggagttggagaccagcctggccaacaccgggaaacctcaaaaatacaaaaattagctgggcgtggtggtgggcacctgtagtcccatagtcccagctacttgagaggctgtggcaggaaaattgcttgaacctgggaggcagatgctgcagtgagctgagatcatgttactgcactccagcctgggcaacagagtgaggccctgtctcaaaaacaaaaaacagaaagagtggccctggaagaaagaagatcaaaagagctttccaagaagaattaagaggtttacaggatctgatttctgcctttatggatttaccgattctggaagtttcatataaatgggaatcatacaatatgtgtgaaattttatgtctggatttttcattttgcataatgtttttgaggtttatccatgtttttgttgttgtggttgttgttttttgagatggagtcttcgctctgtcgcgcaggctggagtgcagtggcgcgatctcagctcactgcaagctccgcctgccgggttcacgccattctcctgcctcagcctcgcgagtagctgggactacaggcgcgcgccaccgcgcccggctaattttttgtatttttagtggagacgaggtttcaccgtggtctcgatctcctgacctcgtgatccgcccgcctcggcctcccagagtgttgggagtacaggcatgagccacggcgcctggcctatccatgttgtagcatgtatcagtacttcattttttttgtgactgaataatattccgctgtgtagatatatttcacattttgttcaccatttatccgttgatggacacttggtttgtttccaccttttggctattgttaacagtgctgctatgtacattcctgtctaagtctttgtttggaaacctgttttccaattctttgaaatatctaggaatggaattgctgagttttatgataattcaaagtttaccttctagaggaaccccagcaaccgtattgttttacattcttatcagcagtgtttgaggggtccagtttctccatgtcctcaccaacacttattttttattatttcctgattattattattattgccatactagtgggtgtgaaattgtatttagttgtggttttgaattccatttctttaatgactcatgatgttgagtatcttttcatgtgcttattggcgatttacatattttctttggagagatgtctgttcaagcccctttgcctatttttttaattgggtggtttgtctttttgttgttgagctgtaagaattctttatatatctggttactagaccctcatcagatatatgatttgtaaatattctattctgtagattgtcattttattttcttcatagtgtcctttgatacacaaacgttttaaattttgatgaagcccaatttatctctgttttcttttgttgcttgtgctcttgctgtcatagctaaaattttatcaccaaatccaaagtcatgaagatctcccccatattttcttctaagagttttatagttttcgcttgtacatttatattttatatcctctaaattttgtttataatttaaatcattgctatagacttggtccagtgagacctataaacagaggtcttaatttactcagtggttaaattgtcctaaaattgatttctgcaaaattcagaggggagatttttgggatttcatagagaaatctatatccatacagttaaatccttcatgatttcatacacttcacttttttaaagtattaaaacttttttatttgaagaatacgtggggagaagagaaatatatttcagcacttagatatgtagattatttccaaaatagtttaccactcaactagtcacttctgtgtaaatcagttttccctgaagcaagcattgtgttgttcccggctacaagcggtcctcattttgcatggtactgtgggaccataaaaatggccatgcaaagcaatcttaataatcaatggggaaaatgatgattgttccatgacctttaaaattctgctaaaatattaaaactcttaaggtcagttataaatgtagaaaaaaatgcaaaaaaaatttaaaaatatttagtacactgtaatttaaaacattaaaaatagaattaaagtgttttatttcattgtgaaaactaagtagtttgaatagggattgccttttttttctgccaagtgacttatgatactgagtaagcatcttttctattcatggcaaactgtcatactccttttaagtttgggtgagcttccagccttttattgcttgtgctttcaatgttgtgaagtatttctgtattcacattaaatgctctttagtgtgaagtttgtttttttttttttttaccgtcacttcctctgggacatatttatctttattgcaatcacttttcttatttgtgttgataagtttgccttcactaagctcctatgaatgcacagcaggaagaacattcccatgatcagtgacttcttctacaaatccatttatgtttgattcaaatttcacttccagtgttatcatttttcgttgctttgttggactttcatctttgttggccagttctttcgattgttcacttctataaaatgtcaggtggaggacaaagagacagtgtaactacgtgctctgctgtgagtgaactgattaacagatgcacagggaccaaccactggaagaatttgaaacaagtaacacgactggtcactgatcatgaagcatatctgttatttacatcgtgatttgtagactgaagaactagcagagaagtttgtacttcctgtaattactcagagttatactgtgctacctaaaattttaacctaggtttaaacaacaccagtttccttaccagtttcctttccttcctggtaaggaaactggtatttaaactaaatctaggtcactgaaatttgtgccatgggaaccgtgcacattgaggacctgcctacaccctacatgtttatattggtccaggcaggcttaatgctgactactgagaaataggctatctgaatttatatcaaatagtgaatcttaaagcacccaagatgaaaaattcgtgcacattgaggtgcttttaaaatctttgtcatttgacaatcaagcttaaaatgtatcttagagtaaccgaattttagaaataaagacctttaaaggccccatagtttgataccacagattatccagcatgtttataatgaattatttctcctccttcaatttcagtttgctcatactttgtgacttgcggtcacagtggcattcagctccacacttggtagaaccacaggcacgacaagcatagaaacatcctaaacaatcttcatcgaggcatcgaggtccatcccaataaaaatcaggagaccctggctatcatagaccttagtcttcgctggtatcactcgtctgtctgaaccagcggttgcatttttttaagccttcttttttctcttttaccagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggtacaagcggtcttccgaattttgcactcagaaaagtggcatcatctaagtcaattacatgcaaattttggggggctagttttttgtgtatgttaaatgggtcacaacacgacttctgtaaatcctcaaatctgtcaatataaatttttatgtgatgaaagcaaattgtattgttcctagaaagtgtccttccagttctaagttgaagtaaaagcatgtcatttgatgacaattcttgcaacatcttaaaacctgtgtgacaagtatagtaggttttatggcactcatttgtagtacgaagctggactgcaactatcgatccatcattgttgattctagcatattttccttgttttattttgtctagagatctaggtcacgggctgatcacccttagcttgagctctcctccgcctggcttccggcaggatccacgtccacacaggcacacttgcctgcccgttcatttcccagcctgtccccatgctaccactccacttcacttattatatatactctaaatctttttcttctcaacataaaacattctacaatcctgcagcctttttacttttttaagcaggtaggcaaacatgtagttgatactcagtggaagcacagagcagagttaaagagaaggaccccctttcactgaccagttgagttttttttctttcctttattttttaaaacaatttcaaaattgagatggggtttcgccatgttgcccaggctggtctcgaactcctgagctcaggtgatccgcccaccttggctgggattataggcgtgagccaccacacctggccaagttgagtttttaaagtagaaaattttggagaaattaactttattgtgcagtgaatgagaaagaaagaacggttttgaaagaaagtctctgcatttatgtgagactgagatgagtcctataaaggggagtctccccaacccctctgtctcctaaactgcattgggaaactcagattaaatatgttctgtgagcatcactcattcaaatgtctcttccattgtaggatacgggaagaagaaatggctggtgatctttcagcaggtttcttcatggaggaacttaatacataccgtcagaagcagggagtagtacttaaatatcaagaactgcctaattcaggacctccacatgataggaggtaggttgctataaaaaatgatatggcagccataaaaaatgatgagttcatgtcctttgtagggacatggatgaagctggaaaccattattctcagcaaactatcgcaaggacaaaaaaaccaaacaccgcatgttctcactcataggtgagaactgagcaatgagaacacatggacacaggaaggggaacatcacacaccagggactgttgtggggtggggggaggggggagggatagcattaggagatatacctaatgctaaatgacgagttaatgggtgcagcacaccaacatggcacatgtatacatatgtaacctgcacgttgtgcacatgtaccctaaaacttaaagtataataataataaaattaaaaaaaaaagaaaaaagatatgaccttataaatgtaagctgggggaatggcaactctggcacaactttgaggtcaacactttagttttgtgagagtgctcttggcataaagtgggaaccatggtggagccacagttgactccagagagaaaagagggtagaaacctttccatgcttcaacaagacatgctgctttactgtttgaggtgactgcttaaatgctatattgaatgtaggttcaaaccctcaaaggtagtcataggaggtagtgatgactagagtacttgtttttagatagtgcatgagttgtataatattttatgaatattctctttgtaatcagg

SEQ ID NO: 236 - DNA, 10000 bp, Homo sapien
caggtgtgcagaacggctcaacaacttgaagacctcaccagaagctgtcagtggatatagttttgcaatggctgctttgttaggtggagtacatcagtgtcctttgggcattcctcatgccaaaggaaaggtatgacggagatcctagacttgggaatgctgtcacgtgggctttggtctttataggaacgctgctgtgtttagtgttgaacagggtggtcaaataacagttgtactatgttatcataaaacatagtgttcttactatggtgttaacagaccctattataatttgatatttaattctgatgtaaggataatagattttgtccaagtctagtaacatgttataatttattttagagggaaagagaaaaaaaacagcctaggcaacatagtgagaccccatcattacaaaaaataaaaaaagttagccaacttcatggtcctagctactggggaggatgggttggaaggatcacttgagcccaggagtttgaggttacagtgagctatgaacatgccactgtccttcagcctgggtgacagaccaagacctaccctgtctcaaaaaaaaaaaaaaaaaaaaacccaaccttagatatagtaattatttgaaagtcagagcttttctttcagcttttagaaataaaagttcacattgctatatattcaaagatgtcaggataatacgctattgtaatatttagcattttgataatgtttagtaaaaattgagtggttttaataaatcatggccgggcatgatggctcatacctgtaatcccagcactttgagaggccgaggcaggtggatcatttgagatcaggagtttgacaccagcctggttaacatggtgaaaccttgtctctactaaaaatacagaaaaattagccgggcattgtggcccatgcctgtaatcccagctacttgggaggctgaggcaggagaatcacttgaacccaggaggcggaggttgcagtgagctgagattgcaccactgcattccagcctgggtgacagagaaagactccgtctcaaaaaataaaataaaataaaaaatatgagtagcttttttttctcctttctttctgttgtatactactatcatggttttcttctcagtaatcttaagtgtttatataaatattatttgaaactttacataggcagattggggctagagttttaaattttgattttttttctgggacattaagcccatgtccattcatagcagttgcatagctaccgatgaaatccagacttccctctcactttgtcatatcgttgcttcctcattctcatcttcctcagactttccatcttccccacacgtcccatcttcctcacaccactttcatattttacatttgcccagagacccttagggactacccagtactcagagagtaaaatataatctcctttgtctggtaaactggtatcttataatttgacttcattccgccgttcattcaaatttcctgttgctctaattagactagttatcttccttccttccctggcctttttcagcttcgaagcctttgctctgctaacctcttagagtttcatctcccctcttattcagctgcaccaaatttaagtctatactagccattctgtgtggatgttaatacagcaaagtaccgagaacagtgctagcccatgtgaccactaaataaatgctgtcattattagcactattattccacattcaaagatttgttgaactcctattatgcatctaccattgagctaaccttgcctgggcgtggtggctcagacctgtaatcccaatgcctagggaggccgaggctggaggatcactttaggtcagaagtttgagaccaacctgggaaacatagtgagaccctgtcatacaaaaaataaaaaatgaaatttttaaaattttccaagtatgttggcatacacttgtagtcctacctactcaggaggctgaggtaggaggatcccttgagcccaggaattccaggttacaccgagctatgattgtgccactgcaccccagcctgggtgacagagtgaaaccctgtctctaaaaaacaaacaaataagtaagctaatcttttggagcttacagtcttagaagacacaggaaaaatgagaagtggatttgtcacatgatgaaatgacaaagtagtagcatagatgctgtattaacttattttatccttgcaaggctgagataggcattcctattatttctgttttaccagtgatggaactaagcagtgctaaatgagaatgcgagtaaatggcagagatggcatttggccctagagcttgtccttaactactacactgttctgggtctcttcagagtcatcagtgcaatcaagactaaccaggtcttgatgttgcctctttcaaaaacatgctaataacacgagaggacaacttcttttttttttggagacggagtctcgctctgtcacccaggctggagtgcagtagtgcaatctctgctcactgcaacctccgcctccccagttcaagcaattctcctgcctcagcctcccaaatagctgggactacaggtgcccaccaccatgcctggctaatttttttgtattttttggtagagacagggtttcaccgtgttgcccaggctggttttgaactcctgagctcaggcaatctgcctgcctcagcctcccaaagtgctaggattacaggcatgagccaccgcatccagccaacaacttcttttaagtaatgtatgctagttatctgtttccttatttaatttaacttgtttgaattaaaatccaattctaaacttttcttgcagatggtagttagtattgctgaagatcttttacgaactgctgcccaaaatagcaggctatctttacagcgcacccaagctggctggcttttacttggagcacttatgactttaggtataattatatttgagtaggatttttgtcacgctataactgtcagtagcctgtaaagcaaatttaatttaaaagtgttaagcttcacattctggattttcattgaagttgtaaaaatggtgtaaagatgttttcctcgtcatttgctagtagatttctctttttggtaattattgcttaagtacatttaatgagaaagttgttagcaaagtttcacctttaccatcagaataacctttgtctacctgatgagtttagtgtttaaaagagatgaaaatatgagggaaaatttcataccctaagtgaaaaccagcagtgtgattttagtagagtggtaaagtcacatttaattggtattgttagtgctgcttttctggggtaacccttaatgtgtttcactcttaagtagtgtgacaaatctgcattgtaggcaaaatttaacattgtacatagtacaaaaatacctattattgtgatggggtatgttcacattttagttcatatgtttagctgctgctgtaaaaagtgtgtgcatatatgtactacaaagttatgacacagatctaagcatctatctgttggaaattatactttgacctacttttcttttctgaagaaaacaaaaagttgcaactcatttccagaagtttatgttaagtatgttcagtggtatgttaaatgaattttttagcaatgtaaatatagattcctaggtctgaatatattgcctttccatgaaactaaattaaccacataaattgcccccaaaactaaggaatatgtatctgtatgtgtgtgtgagtgggtatatttgtttatatacatatgtatatgaaaaagacctcatagaatgtgtctcagatatattttattgataatatgcaatccaccattctcaatacagttgggttatcctttaaaaattgctttttgtgtattttatgtttggattctaaaaatattgacagtttaaggtgaattttgttatgctttgatctatattttaatcagtgaataaaggttgaaaataatgtaattttagagataaaaatagagtgaaataacagatattgttaaacatcagtattttactctattttcatctctaaaattacataaagtttgtgttgggctcattttgcttgacacttgtttgtaaggtatgttacatatacatggttttgtattctcattttcttggctaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtggtaagaactgaaaggattgtgcttcacaatattatgacataactaaaatatttgtaaagtaaaagaaaaatcactattttatagttttttattttactaggtaatgataaattcataggcttttagatttaaatagaaactttataaatgatccacttcagtttgctaattttgtaataaaaatgaaacccagactctgaaaaagtgtttagacctggtggttagacaggaactagaacccaggcctcttattcccacttgttgctatcttacctgtcaaagaagcactgagtcaccatgtataaaaaaaagaaaaaatacccaacagctatttaaagaaaaagaaactcaggattaccaaagttattggcatttgcagttagtcttttcataatggagaaacagctgttttttcacatccttatcaaatctccaaaccttcatatatttttcagatatcaacattacaaaaataacggatacagttgtttttgtctgggagttaacagcttacaggaaacgctcaggttttgtttcgtttgataactagaatgacattggatgtaccagttcttttttggtttatctcagagtgaaaactacttctttttccaaactgggagagagatacatgtttcaccacaagggcagccaggcaagggggcacctttactctcacacatctaggaggtgttttagtctaggctctattgctaaggggccaataaaaatatttttttctcactggaccatttttgtttatatacatatatatttacacaaatatatgtaaaaattcaaaatgcaaaaatatatgtagtggccgggtgctgtggctcatgcctgtaatcccagcactttgggaggccaaggcgggtggatcactctcaggagttctagaccagcctgaccaatatggtgaaaccttgtctctactaaagatacaaaaattagccaggcgtgctggtgcttgcctgtagtcccagctactcaggagattgagtcaggagaattgcttgaacctaggacgtggaggttgcagtgagccgagattccgccactgcactccagcctggttgacagagtgagactctctcaaaaaaaaaaaaaaaaaaaaatatatatatatatatacacacacacacacacacacacacacacacacacacacacatatacatatatatctgtaaaagttgcaaaaatatatttaatatatgtaaaaatttcatgtaaattttaaggcattgtttatacacataaatgtatatgtgtataaacaatgccttaaaatttctttctttgtagtcatctgaattcctatgggatcatagtcctctgaatttccacccgaagaatctctctaaccagtaccttctcttcctccatttttctatccaccttttttctagccttttccacgatttttctttgtagttgttgcaagtttttcttttggttcgacatggtttcagaaccttatacgttataataattaagtattacaactgcctttatatttatacaattttataaattaattcatgttcacaaaagctactccaaatctgtccttttaaacattttatctagccatgaggagcttcgttgcacattgtcctgagctactaactgaagatgtgattcgaaaattgatgacccctattgaatgtgccatgactatgatgtcacagtaagtaagcgattgagacaagttcacatcctattttatatattaataatatacttctcagccatattttgtgctttcttctagaatcatctaggaaacataaaactttatttttgtaatataactttaaaaattacagcaatggtgtggattgaaatacagttgtatcttaaagtgtttttgttacagcaaagatcacaacataagctaaaatgaaagtgtatacttatcagtgtagtttggcagtacattgatacattgctaaaaaaatttataagtaatacttattctggtaagccattaccaactatgtttttgatattttagcattccatctgtaatgaaagcccatggagctcatctgaaagctagtgctgcaatggtccgtttaagactttatgatatcttggctttgttacctccaaaaacttatgaaggtaaattaaaaatttgtggtatctgataaaaatttttctttacaattcttcaccgtattatagagtcttgacaaaggctctcccactgacttactgtgcaaaggaaggccaccattttatttttcttcatgtagagtagctgatacttgttgactccttactgtgttctgggtctcgtttttagccttttgtattagctttttgactgtgttgcaacttatgaggcctttagccctattttatagatgaagaatctcagattgagagacttaaagaaacttaacttacccaagacttagaggtagttaagtggcagagcttggattcaaatctagctggtttatcttcaaagtgtgcacttttgattaatacactgaaatgcttcctatatactgtaatatagcaaataattcgaggatctggagggagaaatcaaatattatgtaaaatattaatagtaaaataaactattgatttctttccagtataatcatgccaaagaattttggtgtgctgtggttcattgtacattattgggcaataaataataataatcatatcacatttaatatatttaaaataaagtatctttgtttgtgtgtgtctttcagacagggtcttgctgtgttgcagaggtttgtctcaatctcttgggctcaagcaatcctcctgcctcagcctgctgagtagctgggactacaagcatgctatggcacccgcctctctttcctctatttgagttttttggttattttaaataatttgggctaaaagacacaatacaatatatgaaaggaagtaccattattgtatattaaaaccagcatttaaatatagattttttttaaagaagagaacagagacttaattattttattcctgttgaacatgttgcagctctttgtgggcaatgattataattttcacaaaaattattctttttaatctgatctgaagttctgttttttaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccaggtaataaacatagaggaaaatgaaatactaacttaatctgaaacaatggtcctattacacattgtcacttaaaaagaaaatagtgtatagaaaggtttaatccccatttagtgttcttagacacttaaagatggcatcctggtggtagatagtgaaaaaagttaaacaggaagagtgagaatttggcaaattgtctttatttaatattctgtgtatttagataccttgtggtggctgtgataaagatcagttttaactggctttttggttattggtattttgttttgttttagtttgttttgttttgtgacaggttggagaggaatgagttagtaggttgaagatttagaacttttgcccactgaatacattatttcttatgtactttttaaagagtgattaaagccccatttaaaataattgtgggattaagatcttgtgtatattgttcacgcaataaggtgggtggtgtaaatatgttttcgaatgaataaagcttttcttaaaatttgtataaggtgttactgatgattttttaatgaccaaattacattttggtctgttttcaaatgttcggatccaatcattctttttttgttgccttttctcctttctcctctgctgtaatcctcattcccaatgtttaataagtagatttcctaaagtagattttgaataatttttatttcactcttttgcagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccggttagtataaagtcaatcaggtaatttttgttaaatatatattatgttaaacgaaaagtagattttctcatcccagttaactctgcaataaagtgagttattataatacttaaaacagtactcttacagatttactaatgtaagtgacagatacatgataaaaaaattgcatgcaaattgcacataatttgagactttatgtaagatttgaccctgtgtactagcatctgatatctgttgtattgtggactgtattttataacaaaattttcattatatatgctagaatgacaactgttggcaaaaaaaaaaatgcattataatagtttgtttgatagttcatacataggttttgactatatcttaaattaaggacatcagtttgctaagcctgttgactttgttgttgaggaagtaaatggatgaaaattccaatcactaataacgtttgtgagatggttcaagtctagaacttggaaactaacataattggttctttttgtaatagaagcattttggtttggtatattctgtatccacagacactattcctagctttagtaggcagtttgtatattgtgattttcccaaaaggaaaacagaaatgaattaatacaagaccatcacagataacttaaaagctttacaaaattaaaatgccttaaaagtattgttgggtctggtgtggtggcttatgtctgcaatcccagcgctttgggaggctaaggcaagagaattgcttgaggcaaggagtttcagaccagcctgggaaacatagtgagacactcatctctacaaaaattacaaaataaaaaatgtctttaatatgtaggttgcttgattaattgctttttaatttgaggagaaaaaagtttaaatatgaaactttacccaaatatctttaagaacatttggttgccacataaatgttaaatgatgttaaaggtggaagaatcttataaagcatctatttcaacattttggttttaaatcttaaggacatccatatctaagagtttggtttacccaaggttatacaactagttatgaaagctataactgaaatccaggattatctcaattctgtatgatcacttttacagaataagatgaagtataaataaataaattctattaaaaatataaacatataataaataacataaatattcaacagtaggaggataagtgaataaataatagaaagtccatttttgtagagacagtgttttgatagaagatgctcatgatacaatgttaaattaaaaaggtaaaaagcaagaagtgatcctactttggttttcaaccagcaggctgtgcggcttaatatatttactgctgttcttagtgcacaaaaggtacttacttacttttaagaattttttaaagtacatcaaaatgtgcatgtatacacgtacatctgaatctgtatcttcatatgagttttgaataatgctttgacctgagacctgagacctgtagactagtataaattgagctttaaatccttacagcgacctcagggagattttattaccaacttgaggtcataattgtcttagtactaaat

SEQ ID NO: 237 - DNA, 10000 bp, Homo sapien
ttctgaggcctctgtttatagaatccatttgaaagtgttctttcttcttcaatattttggaatcatttaagaagaactggtgtaagatcttttttaactttttttataatatgaaaaattataatatgaaaaaactataaatcgatcaggtcctgggctctttttattttttgatagggaacttattactgattcaatttcttcacttattggtctattcagattttctattttttaataatgcaatttttgtaggttttatgtgtctaagaatttatccatttcttctaggatattcagtttgttgtcatataattgcttataatagtctcttatgatcctttgtgtttctgtggtatcatttgtaatgtctcctttttcatattttatctatttgaatattgtctcttttttcttagtttgtctacctaaagatttgtgtgtttatctttaaaaaaaacccaactctttgtttcattgaccttttacattattttttttctctattacatttacttgtgtttttttttcttattacttccttccttctacgaatgttttttttctggttccttgaggtgtagtgttaggctgtttattttagctctttctccttttctgatggaggcatttattgctgtaaacttctctcctagaactgtttttgatgtgtcccataggttttggtataatgtgtttccatttttgtttgtttcaaaaatttttaaacttttagttaatttcttcactggccctttggctattcaagagcatgttgtttgtttaattctcatgtctctgtaaattctgcaaattttcttctggaattgactatctagttttataacattgtggtcccaaaagatattcgatagaatttcagtcttcttaaatttgcctagattatttctggggcctaatgtatagtctgtcctgaaatatgtttcatttgctgttgagaagaaagtatattttgcagcttttggatgaaatgttattttaatgtctgttaagtcatttggtctagaatggactttagatcctttgttgcttttttatccagatgatctattaattgatgaaagtggggtattcaaactccttactattattgttttgcaatcatttctccccttagatttattaatatttgctttatatatttagatgctccaatgttgagtgcatatatttttataattattataacctcttggtgaattcaccccttaatcattatataaagatcttctttgtctctttctatagtttttgacatcaagcctgtgtttttctcatataagtatagctactcctactgtcttttgagttccattttcacaaaatattttgttttttttcctttaattttatccctttccttataggtgaagtgagtaacctatggtcagcattttgttgggtcttgttttaaaaactcactcagtcccggcgcggtggctcacgcttctaatcccagcactttgagaggctgaggcgggcggaccacgaggtcaggagatcgagaccatcctgcttaacacggtgaaaccccatctctactaagaaaaacacaaaaaaattagccgggcgtggtggcgggtgcctgtagtcccagctactggagaggctgaggcaggagaatggcgtgaacctgggaggtggagcttgcagtgagctgagatggcgccactgcactccagcctgggcaacagagcgagactctgtctcaaaaaaaaaaaaaaaaaaaagattattcctaatagatacggtcttactttttgttttcctttgtgtttgtgcgttttctctagtagcatatttttattccttgctttttattttagtgtgtctattttaagattttgccttgtggtcaccatgaagcttacagaaaatatcttgtagctagattatttatcctagtaacaacttaactttgatcactaaaaaaaccttctaaactttaactcctttcttactttccacattttgaattgttgacctcatttatgtttatcatattacatacctttcaacaaattattttagttgttatttttaatagctttttatttaaccttcatagtaaagatataagtaattttcacactgccatttcttttttagagtattctgaattcgactgttttcaaatgtttttttattactcagtgatttttttctttcagctcgaagaactccctttagcatatcttataagccaggtctggtggtgataaacttgttcagcctttttaacattttttattttttgctttggaaagtctttctcccttatttctgaaggatagatttgctggatacattattcttggttggcagatttttttctttctctagcactttgaatgtatcatcccactatctcctgccctgaataatttctgctgagaaattttctgcatgctgtattggagctcccttgaatgtgatatgttttttatctcttatttctttgagtatttttctttgtttttcatttttgataatctgattatgatgtgctttataaactcctcttttgttgttccattggcagcctctgagcttccagtacctatttgttgtctttccccagatgaaaaaatttccagccattatttcctaaatatgttttttagacattttcctctctcttttccttcagaaacttctattaggcaagtgttagtttgcttgatggtatcctataattcccataggccttttccatttttgtttattcttttctttttacttctctgaattgataatttcgtatgtcatattttccagctaactggtttttctgcttgatcaaattagttgttgaagcattgtatttaattgttcaattaaattattttattctttattttgaggatttctatttggttcttatttatggtttccactgctttgtcaaacttttaatttgttcatgaattgttttccatatttcatttaactttttatatgcatttgcttgtaatttcttgaacttaagaggatacttctgaggtcttttttggtcatttcatagatctcctagtttgtacttgtaagcataaaggaaaatgagtatttaatatagaacatgtagaattaagtatttatcatcttgagaaaaatattctattattatttgtaattgtaattggcataataaatataataaaaagtaccttatttaatttcccaaatatcttattatatttttaagatattaccttataaatatgtagacagactaaaattgaatagcagtgtagaatcttgaacatttgagaacttgaaaaatgacatggttgtttttggattaacctttttcattcactcattaatcttttgttgactgaataaagatatccaagtgtcgttattatagtaattttctttcctaaatttcatgatttggagagcttggtggtaagattttttgctcattacaagtattgatctgggacagatctggtgctgcttaaggaaagactaataacatgtcccaagttctcctggttatttttatttaaatactgctggggaaaaggtggtggaaaattattttattccatttgtgtatataaatcactatgcatattttttactttttatattttacatgttatcttagcaaaaagaatattaatagtttcaaccaagcaaaataaatatgaaggctggattattaaaagtgacttttgcatttttaaccacattttatctttgaatttagtatcatatacaggagatatgaaaataaaagacatttatttttataacagtattaaaaatctattgaagtattgattgaagaaattcagttgaagtatttttgtaaacattgtgattatgtgggttattaagatacatacaaatgtggttttaaaattcaacaagagtaaggccaatatattttagcatgtgtaatttgtaaaaatacatgtttgtatttgtagtaaaacttatacacaagatcaaatatgtaaatattaaaggagaaggagttgtatatgtatgtaaattgtttcttatttgaatgacatttagatactgtcatctaggtttagctatattttacagtacaaatttaattaaaatatatgctatggaagtattttaatgattttaggttgaagttataaaaacattcccatatttatttctttccaataaggaaaatttgtcagagcatataacacaccatttattcttcacttcattattttatctaccttttcctatgtgtcttttaattcttaatatttactaaaatttctatatcaaggaataatacacagagcttttaccttcaagttatttagtattggaatagtgcacaaaattataaacattgagataatgcaggcagaataaagtacccaagtaggtttgagaaatgcaccatcagctttcactgaattatgaaatcccaaatactgctgaagggtcaacaatgaaagacagttgtactgagaaggtaaagttttgaacgtctcttcatttatatagagggtttccccttgatagggaactgaggataaatatttgaagaaatatgatggaggtttccagcaatactcataataattgaaacatctaattaaaatagggctaacatcattcatcagcctcacaatatcagctgttttccaagaacttcttatcactgggcctcttgtttttttatactaatgtatgtttgtttgtttcattcccctcccccaacctccacagaaaaacccttgtgaagagagaggatgggtgttcacaatttgttcacggtgactcagtttatccttatagggctctcttacttctccaatgagcactaccttctttttgtggcccttgccattatctgtcaggtgttcttggtgcgaagtggagacattctcttggccattgggactgtgattaagttgcacactactcatgtattattttttggcaaatgtgtccatcttagacatattgtgttcatcagctactatacctaagatgcctaagattctctagactgaggatcacagcatttcttttgttaggtgagctttgcagccctatttcctagtggcctgggctgggaagaaagctttctcactgttacggcttatgactggtgtgtggtcacatgtttctccctttgttacatcctgatcatgaacaaattggctctgtccagctggtttatgggacctgagcagctgggtttctaaatttcctcctcctccacgtagtgtctaccctctgcctgtctttctgcaagcctgatcgagttaaccagtattactgtgatatctcaccgatgggggccctgttgtgccagtccatgcacctggcaaacatgcttgttttagtggaatcagttatcttggggatcagtgcttttctggctgcctttaacttttacatatacatcatctccactatcctaaagatccagtgtgtagagtggagtgcaaagtgcttctctacatgcacttcccacctccttacggtctgtttgttctatggcatattgacatttacctacatttactccttctccagtcaacactcacatgtctaaggcaagcccagatctagccacagacaggctcatctctatgctatacagagttattaccctgatgtttaacttcatcactgacaacctgagaaacacagaggtaaaaggagcctcagaaaggttttatgtcattgaacatgtttatagaaaccataatttaaaatataatagaatgactcaatgttccacttttaattcatagaaaaagtaattttctattgatatatagaatgcatacctacataggcgtataaatttatagaaaatacatatacatataacttcagttatatctatttatatgtatatgtatatttctatttgtgtacattgggaacttaacatttatcagccaaagtagactttttttttttttttaagttctggggtacatgtacaggatgtgcaggtttgttatgtaggtaaacatgtgccatggtggtttgctgcacctatcaacccatcacctaggtattaagaccagcatgccttagctttttttcctgatactctccctctctacgccaccctccacccaacaggtcctagtgtgtgttattccctgtagactttttcagaataaatcaggaactgttagtagtaattacactggtataagatgtttaaaataggcctgtcttaggctgggcgcggtgcctcacacctgtaatctcagcactttgggaggcagaggcaggtggattacctgaggacaggagtttgagaccagcctggctaacatagcgaaaccctgcctctactaaaaatacaagaaattagccagatgtggtggttggtgcatgtagtcccagctacttgggaggctgaggcaggagaatcacttgaaccccagaggctgggttgcagtgagctgagatcgtgccactgcactcaagcctgggtgacagagtgagactctgtctcaataaataaataaaatggtcctatcttaagtaaacttggatctataacacttaactatattcatactcatgcttgtacccatagccatatttatgtctaccaatatctatattgtgtgtgtctatatggtttatatctggctttcaacctgtatttaatctagctgtaggtgttttctttaatttttttcttttaattgttcatttacacttggaaattgctaagagagtgaatcttaaatgtaatcacaataaaagataattatgtgaggtgatggatatgtaaattcattttgtttgataacttcacagtttatacctatataaaagcatcacattgcatactataaatatatgtatatgtgtgtgtgtgtgtgtgtgtgtgggtgtaaactataccttaaggctgggggaataagctaaagtggtcaacataacctattatatgataaagatatatctatgttggaaatttttctgatattgttatcaaatatgtaagatttaaatgacagtattttcattatattatttgtaacctgtgtaaatggaataaaatacccatttatggctatctggtgaaactgttgggaagtaaagcctgtgcattgatcacccttctatgtttgttgttattgatacttctcctttttgttgacataacatgctatgacttcttctgtagttttactttcaacctacttgttttgttactttatgtgagtttctcatagacagtttatagttcaattatgtatttttatccagtgtccaatctctgtctttcaatttgcatatattattgcatcatttacttttaaggtaatcattaatatgctacaatttgtcgactttttaatttgttttgtgtttgtttcttctgtcttttatttctctgcttttcatttattgattttctgatgttttctttaagatttttaaggattctaacttatgtatagcatttttattacatcacaatgtatagtttttttataccaactaatgttgttataatttttctttcaaccataaaatataatttaaggaactcatgagagaaatatagtatattgtaattatttctctttgtacaaaatttgctttttcctgtatgacattgtggctttcctatctctgtagaaaaccatatatactgtactcttaaaaatactaagagagtgggtatacagtgtttccaccatgaaaatgataattatgtgaggtaatgcatatcatatgttaattaactaaatgtagtcactccacaatgcatctatacttcaaaatgttaggctgtaaacaataatacataaattttatgtcaattatttttgaattacaaaaaaatgaatgcaagttgatctcaaaaagatgtcataaagaataaataaaatgagaacacaatatcaacaaattatatgaacctaacaaaatagcctaaaaaataaaccaatagtattctattttcagaaatatcaaatatgtaaataccttaataaacttgaaaatgcatgcattaaactaatactgtatactatactctcccaaaaaaagagtggagattatttaccagcacatataaaacaacttaaaaatggataatttatttcaccctaaaaatgagtctcaataaattccaaaggttcaaagaattacaaatattgtggaatgtgtaatacatgtatgcacatgtggatatatgtatatctgtacatataggtatatatatgtgtgagtgcacatttgtatgtaagaccattatgaagctatctctagattatattgttaagtaaaaaaaaagtataatgcagaaagggatttttaatatttgcttatattacagttatgttacatataacatataatgaaacattgcatatatacatatatataacagtttatgatatatataacatatatgtataacagttctatatccaaggttatataacatatatctaaggttatatatataacagtttatgatatatataacaacatgacattacatatacatatacagtaaagttatatataatatgttatatataacataagtgttatatatgttatataacatgttactaatatatgtcacatatataaaacaaaatgttataattataaaacaaaatgttatacgtgtaaaacatgaaatgttttatcattttctttatcaatttatctgatgatggacacaactgctccagatgtatttgtaagacaaaattccaacatgttttcataattgtggaaatatattgtaaaaatatgctttactaatcacagcaaatgatatatttcttccaacttgttataagatgtgttgtatattgtatatttttattatgtagcctcagttttggcattctcactctctcaacctaactttatttcatgatttagtttgtgacttcaaatctgcatttatgatacatttgctagtagatactcatagcaactgccatagtatagacacccatttctcatcccatctatgttacatccaaattttttcaggggtgccaagtgcctaattttagaatatactcttccaattggtacttacaacttgaaatggtgtaataatatagctatagccaatgagatgtagcttatacttactgggttatccttataaaaataataggcagtgcttcatttgcctcatgaaatctctgtccttagccttcattctacttgggttatggatgagacgcctagtaatacaaaagccattcatgatcctagggaaaacaatattgaagggcagaacaagatgactgaaggtgcctgtttcattgatggacccattgaaccgccatacacactattgactgcctgcctaatgtcagactaatgttgcatgaggcataagtgtactcactggtttaaaaggactggagtaatattctgtcactttttcctgaacacatggagactttagagtttgcccaataattttattcagtagagcacgatttttctccaatgaaatctaaataacgtaatgaggttcaaccccagagtagatacctcattatcacaatgctgtaagtgaatgaacccagcctattaagcaagggaaaatttatcacacacactacttctctccagctcacattcacataccaacaaataaatggcacaaaatacacaaaatgttttgtgatatttgcatgtatgatgtgcacatgcacatataggtaaatatttgtgtatatgcatatataagtattcgaagttatgtacatatttttggaaaatgttggaatatatattatgacatatatttatgtgagggtattgtgcatattgctttatgaatattcttcacataaagagtacagaattttggagacaatgagactgctaggaagaaggcaggaataagagggaagggaaaattggagtggaggtaagtatgaaaaatcagtaaaatctgagatgctctagaagatggttctggagtacagaagtgatgttgcatgttgaaact

SEQ ID NO: 238 - DNA, 10000 bp, Homo sapien
gctactccttgaacaataaattatcgcgtcccctggacacagttactccatgtccatttcacctaatgtagatatttgcaccgcctgactagattgcctgagtgtaatgataccacttaaaattaaccccacaaactctccaggagaccacaaactttttcttctttgacctcagctcctggaacaggacaaggtacaaaggaaataattttaaaatatttgtttaatgaaacaaattgactagtttcacagatccctctgcataatacaaagttctgaaagtttatggtcctggttttcaattaatcctccacactggcactggtctaaggaaactgaattgacacatatgtgtcccacattccaccattacagtattagccctttcccaccaactgccccttatgaagcttttcagtcactgcaacactcccgacaccaattatctcatctgttttaaaaattcacagtacttcatttcctccacttaaaagtacttgggcttcctttactcatttaattgacacagtcgagcaattgctgtgtatgtgcttaggttaacatcaaatttgcctgtgtatcacagcatacattttaataggatgagtttatcaggctatctcagccttatacatgttctctcagtgtatgcttttcggccacataatgaactacaaatttttgctcaacccttttccacatagatctgagttttcttcctatgggttttctgtaacataaaataagacataattgatcacggaaggcacaaccacattcactgcattcacaaggtttctgtcctgtgcaaatcctctgttatctcctgaggctgcacatctgaccactggctgtcccacaaggactacgttcctgtttgcgaggaggccgctgatgtttaatgatgtctgaggggccacagaaggcacttgtgtagtcgccccgttagcagagtttttctcctgcatgacatcactggtgtgtaatgagctgtgcctctctgcaggaggattttccaccttggctgcctcttgtttctcccttgtgtgtattctcttatgcttaaccagacacgacatatacgcaaacgctttcccacactcgttacagccatagggtctctctcctgtatgagtcctttgatggacaatgagcttttgctttgtgctaaaggctttcccacattcactacattcaaagggtttctctcctgtgtgaattctttgatgtttaatgagacctgatttctgagaacaggattttccacattcactgcacacaaagggcgtctttcctgtgtgaaatctctgatgtgctatgagacacgtcttctgaatgaagccttttccacattcattgcatatataaggtttctcacctgtatgaattcgctggtgtacaatgagatttcctttctggatgaagccttttccacattcactgcatatatagggtttctctccggtatgtgttttctgatgtatgttgagccgtgatttcttgagaaaggctttgccacattcagggcattcataaggtttttctcctgtatgagttcgctgatgttcagtaagcatgaactttctggagaaggctttctcacatagactacatctgtggggtttctctcctgtatgcattacctggtgatcagttagccaagacttcttgatgaaggctttcccacattcactgcacacatgatgcttctctaattttcgtgttttctgatgcttgggactgatgaattgggacttagtgctgatgagtttttgacttgcagggaatttaattgcagtatgaagtcgttcatggttagcatgaagaaaggagtccccatttccagtaaactcaacagagttctttatttcatagcctttgctctggttaactaaagttaaattggatttcaaactttttccacgtaagtcaaatatatcatgattttgccctaacagaaactgacttttgctgcaatgaacaatattttcaaatgcatcatgttcatgacatggtttccttctgttcaccaggctttcactctgcaagcgctccagcacatgatcaactttccatatgtctagaaagaaaagaacaaagatttctatcatttagatttggggtaaaagtttgttgtggtttttttgttttttttgtttttttttttaagatggagttttactccgttgtccaggctggagtgcaatgctgcgatctcagctcactgcaacctctgcttcccgggttcaagggattctcctgcctcagcctcccaagttgctgggattacaggtgcctgctaccatgcccggctaatttttgtagttttactacagacggggtctcaccatgttggccaggctggtctcgaactcctgacctcaggtgagccattgtgctcagccaaagtattttttgttttgttttgtttttgggagacggagtctcactctgtcgcccaggctggagtgcagtggtacaatcccggctcacagccaaagtattttttgttgttttttttttgttttttggggacggagtctcactctgtagcccaggctggagtgcagtgacatgatcccggctcactgcaacctccacctcctgagttcaagcgattctcctgcctcagcctcccgagtagctgggattacaggcatgcaccaccgcacccagctaattctgtatatttagtagagacggcgtttcaccatgttagccaggctgatctcgaactcccgacctcaggtgatctgcccgcttcagtctcccaaagttctgggattacaggtgtgagccgctgcacccggccccaaagtattcttttttttaatgccttgatgtgaggtgtctcttagtaataaccctatgacctgagtgtaaataaaactccatgtttaatgttccttgcacattggcaaaaagtaatagtataaacaaactaaaaggtgaaagcagttagcataaaacaaggttagatcactaataataaagacagatttggctgctttctaaatgtgccttgcaaaacagaccttaaaatacaagcaattcactgtgaccagcagaccagaggctggaggcccatttcgtccaaagaacagattcattcattccacatactcttactgaatgatcaccgtgtgccaggtatggtgctggtgttggggataggcacaagaatcgcttgaatccaggaggtggaggttgcggtgagccaagttcacaccattgcgctccagcctgggcacagagcaagactctgtcttaaaaaaaaaataaattaataaaaataaataataataatgaataatttttaagggaatgagtcagggaagtaatcatatgtgtggaacacaccaggcagggtttaggaaagaggatggaaatctctttgtgagcaagatggtattatatcacagagatcactgaaatgagaaatttgacaggtaacatggtttactgggacttggtgtcatcagaatacgatggggaaaaaaacgaaagcaaattattaaatacagaaaggaaccaaatggaagtaggcgggagttgagaatgtaggatgttaaaaaaatgacttttttacttagagatgcatcatgactagcagagacctttaaagaagagagctcttcaggcaggtaatacccagatggccaagattcaggatgtacaggaacaaacgaaaatccaaacttaatggttttcttggaggaaagatgattctagttccttgcagttactaggaactcaggggagagttgccatgaagtaaattacacagaactaaaatctgtgttagataacaacagggagatgtcagtttgggactctcctccagggagcggaaggagtttaaacttactagaatgaaggcaattttgaagagtgaagggcacagatgagaaaatggagaacgggacctttggagaacctaagaataaggaaaaagagaagcgaaggaagccaaggcacagcgaaagtccagtttaccctgaggaagccacatccaacacaggggaggtgttaggaggggaggtcagcattagccaaggggcacaaaggggtgggagtccgaaaacagtgaggacttcaaagtttcctctttggaaagaggcctggaaggtggaatttcgtaacaagagaggtggaacaacatgaagaagggaaatacttgaaacccgaggaagaagaaaattatgcaggcaaacaaacaatatgtagataaaataatcagatctctgaggagataaagagtttttgttttgttttgtttttttttaactctaaattcctacaaagaaaaactggtctcacactgggagacagatgagtagaggaactgtttacatatcctcaaacccccttcacagctgtgctgccttctctgactgtctagaatgtgacttccatagccttctgtcttgtgggttctctcacctgaacaggctccactgtggattccatcttcaattgtccacagttgttctccttgttccaacttgaagagtgcatccggtttgctggcttgataccctgttcatggaaaatgatagaggacttagacatatcaaattgggctggcaatgtcaagaaggaagaatgttacatttcaagaaacttgagtttcttaaaatacccaaaatttagtttcttatctgaaactatgaaagtttcgtttcatatctgtaacatcaaggtttttctcttacaagagggtagattacaccgtcttgtgtgggagcaagagaaggatctgagaatctaccacttcagagtactgcaggcattccaaagaggtaggcatctgagaaaggaaggccactgactaggcaccctctgagtgacacagggcagctgtcctcacccactgccaccaggttgctgtagttctccaacatcacatcccggtacaggtccttctgagcagcgcccaggagttgccactcctcccaagtgaagtccacagccacatcctccagtgttatggattcctgtaataacagtcctgtttaataaagtgatgtctttttgatgatgtggaagaaatgctaaagtttttctgctcatttccactctacaggctgtgtgcatataccaaatagttttttttttaatacaatgtggaagaagtaaagtcctaatataatattctgtaactgtatattcagtcatcctccattcacccaattggaagtttctataaagtgtagaagttaaatcttgctaacctaaaaacaatatatttatacattttatatatgtaaatatatatgaatatatgtacatatatttattttagatacatgcaaatgaaagacatatatacagccatcctttagtatctgtagggtattggttccaggacctcctgaggatactgaggtgtctgatataaaatggcacagtattggtcaggcacagtagatcacacctgtaatcccagcactttcggaggccaaggcaggagggtcactcgagcccaggagttcaagaccagcctgggcaacatgagaccccatctgtacaaaaaattaaaaaattagctaggcacagtggtgagtgcctgtggtcccagctacttgggaggctgaggcaggaggctcatttgagcctaggagttagagactacactgagttatgaccatgctactgcactgcagcctaagcaacagagcaagactgtctctaataaaataaaataaaatggaatagtacttgcagatttgcatgtaacccatgcacatcctcccatatacatttctgtttttttgaaatggagactcactctctttcccaggctggggtgcagtggcataatctcagctcactgcaacctccgcctcccaggagcaggcaattcttctgccccagcctcccaagtagctaggactacaggcatgtgacactacgcctggctaatttttttttttttttttttgagacggagttttgctcctctttcccaggctggagtgcaatggtacaatcttggctcactgcaacctccgcctcccaggttcaagcgattctcctgcctcagcctcccgagtagctaggattacaggtgcccgccaccacaaccagctaattttttgtatttttagtagagatggggtttcactatgttggccaggctgttctcaaactcctgaccttagacgatccacccacctcagcctcccaaagtgctggagttacaggagtgagccaccgtgcccagccccatatactttaaattatctttagattacttataatatctaatacaatgtaaatggtatgttaacagttgttatactatattgtttagggaatcatgacaataaaaaagtctgtatgtgctcagttcagatgcttaaaaaatatatattttcaatcctcagttggttgaatccatggatgtggaagccatggatatggagggccaaccatatatcacaaatccaggcctcctatttttctgatggactaattataaactgagggttcctatgacctccttgagtttgataatttctcaagaagaaggagaaaatcaagtaatggagaaacaatatccaaagatctaacactgaaaatttttcagaactgattaaacactccaaaattcaaactcaagaaatccaacaacttttcaagcaagaagtctacacgtaggcacaacagattgaaactaaattacaccagatacaaagggagactataaaaaaatccaaagaccaatgacaggttacctacaaaggagacaaaattttctgacagctgactgctccacagaaatcattatagccaataaatattggaacaataaatgtaaggtcctcagctcttggacaacacagcccaaccttgaagaccatttaggactgaaaggcatggctggcaaaggacctacagccctgtaatagtgacaattaagactacttatcaatgaattgtcaatctcttgtctcaggatgcaggatggctttaaaggatactgctggtgggaaattgagtcattgaagacccagggaacagcagaaggtacactctatactcattttattacagaggccagtgaacacacttggtagatgatacaagtacttaatcctggttggtttacccattctaaattatttatgtgagatagctatctatttggaaaaaagtaaagtgaaagtcttacctcaatccacactcaaaaatagtttactatatgacagatctatggcaggcagatttgatggctcaatgaactccaccctcccagtgttcacacctttatgtagttcccacttacagggagccaaaggtccgtgggacgtgaccaactcagcattccactggaggctatatgatcaaacagcaaactgtttatcatgaatgcaggatgtgagcaaactcaccattgctcctgccgacagaaggttttctggaggcaatcactccctggtgctgaggttatctactgcaacatttagagaatgtagtcttgcaagcctcctctggactgagcagctgacccctacttccactgcacccccccaactatctcttttgcctaataaatgcagagggctgtgtaaagctcagggcccttgtccactagaggcaaggtaccccctgaccccttcctccgaatatacttttgtctcttgtcttttattcctgtgttcaccccactgtgttcagtccccctaggtctgtgcgggttacaagtggcgcccaaacagggacagaattgggtgctctacaccctctccttgagcagggactggcctagtgacttacctctattcagaatatggcaaaggcgttggaatctcacctccttaattaagctatacatgtttaaaaaaattattcaatgagaattgttaaagcacagtaaggaagactttattcagggccattatgacaggtatatagacaaatgtaatgggattttgcagtggtagagggtgaatggacttaactccaaatatcagcataagcaagtgggaatttatagccaaggagcagagtatgggtcagtaatacaaaattaccaagagggccaggcacaatggcttatgcctgtaatcccagcactttgggaggcaggaggattgcttgagcccaggagttcaagagcagcctgggcaacatgacaagaccccatctcaattaaaaaaaaaaaaaaaaggaaaaaagaaaaaaagcagaaaagtaaaagtaaaaaataaactcatagtcaacccacccccgccacacacacacacacaaaacctttatgatcttttatcatttttcagattaaatacttgattctctcctaacccccaatggtgacaaatgcatttttttcaagtatagctataaactgatggaattttatataattaatgttcttcaatcatttgcaatcattggtctttggatgttcaaagtgtagcatcttcggccaatgaagagtcccttcaagttggctgctatgttctttgaaatatgattctatcatgtaaaatatatatatgtgtatatcataatgaatatatatatctacagatagattcatatatactcacacttttattaatacatatatagacatagatccacaaacagatacagtgacaggaagtaaatattaccaaccatttacagaagtggattaggaagaaaatatgtgaaaagaaaactttttctcttttcttcaattttactaaatatagacaaggtctcactagattgcccaggctagtctcaaactcctgggctcaaggaatcctcctgcctaagcctcccaaagtaggcataagccactgcactcagccagaaactttttttttttttttttttgagatggagtctctctgtcacccaggctggagtgcagtggcaccatttcggctcactgcaatttccgtctcctgggttcacgccattctcctgcctcagcctcccgagtagctgggactacaggcacctgccaccacacccgaccaattttttgtatttttagtagagacagggtttcacggtgtgagccaggatggtctcgatctccagacctcgtgatccacccacctcggtctcccaaagtgctggattacagccatgagccaccgcgcccagccgaaatttattttttgatatgtgtactttcttactttactgggacacaatcacagatgacctatgtggctgatcttaggtccacaccctcccagaagtcaggttttaactttagcctctagttctggaagtttctggcctatcatagatcacagatctatcatagttcgtatttttaggctgtccagtggccaaaggacccaagcaaacaaagacactaccattagcaagatattccagaagcccagagctcaccctccattagcttgaacacaaaggccaaaactccctttgttcaattatttactatacaataaggacttggcattttctacaaggtgaaagtctaaaggaaatctgtaaactccaatccaagtcctgttcagacaatatcactttcaactccctgtctccaaatctatattcaaacaccagttcagctatctgttcattgagaaccatttgaaagtcctggaatcctgccatattcccaggatgtctaggttttattccaagttaaatccagactgccacaaggctgaaattaacttgtgttggtccctgtgtttactgtttgcttagtctattccgtaacagtatataaggagtccttcaagaaacagccacaggaaacctgcatctgaatttatgagaaggctgctattctggacaccatccaccacatcaactctaggaagaaccactgaagaaatttcctgagaccaaagtgccatgaaataatggcaacccccaggaagtaatctgttttatcttcaaaaacaggacataccatgtaaattatgattttcttgtgacattggctgtcagagatattagatgcaagctgacagctaatataatccacaggatcctccagccatgcatggtgtca

SEQ ID NO: 239 - DNA, 10000 bp, Homo sapien
acagaaatatgacttcaattgcctgttcctgtgctggggcagaagctctgacggcttcagaggtggcgctccccacccccacctctgctgagtcctcgggggggcctgacaggggctgctccttccactgtggctccagctggagaggacctggagcagcctgtgctccacactggagatgggcaagaaagacacatttgctgttggaagcccttgagatttttgggttgttaattaccataaacctaacctggcctaagctgctggacagagcagcttaaaaagaaaaagtttctatttctctcttcttaattccaatgtttcttcttaatactctcaatgccattgtcaataaaactgtgaagactttctcacttctgggtttggctttgattgccaggttttaaagattgaccgttcaggctgggcaaggtggctcacccctgtaatcctagcactctgggaggccgaggtgggtggattacctgaggtcgagagttcaagaccagcctggccaacatggtgaaacaccgtctctactaaaaaatacaaaaaattagccgggtgcagtggcgtgcacctgtaattccagctactcaggaggctgaggcaggagaatcgcttgaacccaggaggcagaggttacagtgagccgagatctcgccactgcactctagcttgggctacagagtgagacttcgtctcaaaaaaaaaaaaaaaaaaaaaagattgttcccagacgggctgcagaggtaaggaggaggtaatgcagcggcagcttctgtcctggtgatgctgccgcaggtcgctagagctgtggtactgtgaccctgctcctccactaacagcatcctcttcacacaactctcgccagtggaagcagctctggacttggggccaggacatctgagttcaaattctacagccgccagagactagacctgtggccttggattactcaatttattataaaaagcactatttattgaggacctataagaagttagaggttatactaggcactttacaaacatcatctcatccagtccttatgagaacatcaaagaagtaatgattaccccattttgtagatgaggaaactgaagatcagcaagagaaaggaatttgagtaaacgggtggcagcttttgaaccaaagtctacttgattccaaagcttgtttttaagcttctttattaaaaaaaaaaggtatatatatatatatatatatatatatatatatatatatatatatataatttcacacacagagaaaacaatataacagacagttaggtaataatcagagataaaatatgttagcctttgccatatttgtttcagatgaacttccttccctgccccagagcaaccactgccctaagacaggtatgtttttgtttattgttcttggtactttgtttttttctctgtacctttcctgcctttgtaggtgtccataaacaatacatactgcattactgtttgctgtcttttaacttttatacacacaatgtcacactccagttgtcctctgcaactagcttttcccacttagttttatgtctcctgatttatccatgctgacacatagagatctatattatttattctaattactatattgtattccatggtattagtaagccaaaggtttttgtccatcatcctactgaaagtaggagacattcacttgtaaacttacacactgactcataaatagaactgttcaaggacttctccaagccccatccctagaaatgaagtttctgggccatggaatatggccatcctcacctcaccaggaattgccagcctgtggactgtcccagcttgtctctttctactattccacacaattctttaggccttgtttttctcagcaacaaagtgaaaagaaatgcagtggcctcagagggttgtagtgagaacctcaatgtggagaaacacttcaaaaactgcatccagatgggaactgccggccccgtgccatgttcacggctgttgctcacgacagcctctggcctcattgctgccagccttcacggttccacttcctcatagtcctagtttagaaaccactttcaccaaaaggcactgactctttgctattctgatcataaattcataaaacattaagttacttcaaaaacttcaccattatttcagcaagtaacttcattactgctgtcgaattgttctctatttgtttcctgcaagggtgatcatcttcctaacttggatacagccaaagatcaagagactttagcacaggcttgttggtgcagcagacacttcataaatgcttaacatcataaccgatgaatatttattgagcactttctatatgtctgactgtcctaagcacttgaaagccaattgtgggccaggcaccactgtgttaaatatttacttgccttgccttatctaggttttttttttttgagatggagtttcactcttgttgcctaggctggagtgtaatggcgcagtcttgactcactgcaacctccgcctcctgggttcaagtgattctcccgccttagcctcccaagtagctgggattacaggcatgcaccaccacgcccagctaatttgtgtgtgtgtgtgtgtgtgtgtgtgtgtgtgtgtgtattttttttttcagtagagacggggtttctccatgttgggcaggctggtctcaaactcccgacttcaggtcatctgcccacctcagcctcccaaagtgctgagattacaggcgtaagccacggtgcccggccttgtttgtttttcataatgaccacatgaggcaagctattattctgctttttaaacgaagaaaccaaggcacagagagattacgtatcttgcataaattaacacaggttactactacatggcagggccaggatttaaacaaggcagtctgattttagagcctgtgatcttaataagtatatgacactgtctctcaatgtgtactgaggtttgccttacataaaaggcatgtaatgtaggagttcaaagttatcgctatggcatttatatccagagggtaagcattctctatttttatggttagactaaaattttaaaacactgcttctagaggcagtttcccatactggttgaacacacaagtgatggaaccaaagctaaagggaaaagcaggaaccctgagaggtaagcagaacacagatgctttaccccaagggcatttacgcattaggcaagtctgatatttggttatgatgaagaggacgaatgtcaaagcccaggatctgcccgaagtggaaggtgtaatagaactccctcccgacactaaggattcccaatgggctatacccataaggtaaagatgcacgagaatggcatgaattttcacctctggtgttctaggatactttaaagtaatttggacttgcaatgtgcccaggcacacagcacaatcctgaggggaagtatcttaaaatctaggtctcatattaatacagataattatctttaaaaaaaataagcagcacataatcaaagataatcaaatctatgaggaagtaaggtgggatcagggaaaactgttaagaaataacagctagtatgaagagacaaagaccacagatacaagaattatcaactataaaacaactttgcttacaatgttaaaaaaataataaaaggcaaaggctagaaatataggtcgtaggaagtcacagagagtgacttgatctagtggatttgaaaagaaccaaacagaccttctagaaattaaaaaatacagtaactgagatttaaaattgaaaggagggatttaacaacagattggaaacaagacagaactataaactgagtattaggacaaaataaattttcagagcatagcctaagaagcaaagagaatacaataaaaggtctaattagtgcatgtttgatcataattctagaagaaaaatggggcagagacgaatgttaacaaagagtacctgagacttttacagaactgacgaaagataccaatccacagatttatgaagcccaacacaccctaggcaagataaataaaaataaatctatatctaggcacatcaaagtgaagctataaaatatcatagatagagaggaaaaatctgaaaggcagctagagggaaaaaagaacaattcctctcaaagaagaaacaggtgacagctgacttcttaattagcaatgatgaaatctagaagatagtggaataacatcttcaatgtgctaaagaaaaataaattatgtctttgaaaacatctttaaggaataaagatgaaacaaaaacatttacaggcaggcaaaagctaagaatttgccaccagcacatttaaaaaaaaaaattctaaagcaacaattctcaaatttttcgtcctagggcccctttaaattcctaaaaattattaagaacttaaaaaatgtgcactatatctgtcaatatttaccatattaaaaataaaactggaccaggcacattggctcatgcccgtaatcccagcactttgggaggccgaggtgggtggatcgcttgaggccaggagtgattcaccatggccaacatggtgaaaccccatttctattaaaaatacaaaaattagctgggtgtgatggcgcagacctgtaatcccagctactccagaggaggaggcaggagaatcactcaaacctgggaggcagaggttgcagtgggccgtgatcatgccactgcactccagcctgggtgacagagcaagaatcggtctcaaaaaaaataaataaaataaaataaaaataaaactgaaaagtttaaaaatatttagtaattcatttaaaagtaacgacaatgaacccattatatgttaacagataacatttttttttatgaaaataactatattttccaagacaaaaaacttggtaatgactggcaatgttttggttgttttttctttgataatggcgtcttgctctgttgcccagggtggtcttgaactcctgggctcaagcaatcctcctgcctcagcctacctaatagctgggattacaggcgcatgccactgtgcctggccaagactggcaatgttttaaatttttgcaaatctctttaatgtaggcatatgtaactagagaagggaggagtattttaaaagattttttggataatggtgtaagttcttctttaatgctgcattaaatgcaacaaatgatagtttcttataagttggttgcaatgtgtaatctgaaatcatatcaacagacattcatattctgttacattaaaatttattgctctgtttagcactatgaacacaaaatttacccatgcataattttataatgtcatacattggtcatttggaaaatactggttcactgacttataaagatcttccaagtgtttacataattcattacacaacataatgatatgtaagccagtaatgggtaaacagagctaaagtattttaatgtccctctattatataaactgtagtgtaaaggtagtgaataaagtatggtaatttctagggtaaccacacaaaaattacaaacaacgtataatatgaggaaaaaaggaacgataaaaaaaaaaccttggtctgataaaagaaaagagagagagagaaaaaaaaccactgaacactaaagaagtagcacaaaataataaggtagatttcaaactcaaaatatcaatgattatatcacataaaaggtctaagtgattcagttgtcaggctgtataaacagtgaaacccaatatattctaatgcccagaggaacatctagcaatagaagggctgaaagtgagaggctataaaaagatgtatacaaatacaaagaaaagtaataccacacaaaaaagactttaaggcaagaaccatcagtgataataaaggctacttcctgatgataaaaggttccaatttgccaggaagctataacagtttaaaatttgtatgtacctaataacatctgcaaaacatataaagcaaaaactgacagaacagtaagaaacagatgaatctgcaatcatagccacagatgtaagcatatttatctccctgcataactgacagaataagcagtcaaaaaaccagcaaagatataggtttgaataagaataatgaaattgactctatggacatttaaaaaaaatctgtcttcaatcagtgcggaatattcattcttttctaaaatatactgaacaatgaaagaaactgacccaatttcttaaggctaaaaaacaatttgaatagtttgtacacagatttgttacccctgctctatcagtagttcctcaaaggaacaaaaagcctttctaatttctatgtcctcagcttttaacatgatggttattaaaataaaatgtgttagaattcaaactaagaaacaaaagctgatccagaaagtagtaattttccagatgacatgatacttttagtgtatttttctatccattcaaaattatagctcccgccaaaaagcataataatatgctttacgatgtgcgacgggataaagcacaggtgagagaaatacgggatatcaatgaaaacagaaaaaaagaaaagagaagaaacagagcaagtgaaagaattacaattttaggtcaggaagtgtgaggacaacccaggcgttttcagttgttggttaatggagttaatttcaggggcaggaaagagagagaacagaggatgataggaagaagagagttgtgatcaataaatatgactgcaggcaaaaataagcctgaaaatgtaagttatcaacaagaggaggttattcaagggaaacatcttctatcttacaatagccattcacaggatcgacggatggggccttagaaaactgcttgcaaagaatttggttgtcacttcgttttaactttactgtttgccggctgttatagtggaaaatgtttgttggaggtagagactgaagctattgtctacaataattttcagatgttcatgtgctttactatgcaataattacgcatgtgcaattgagaattagctcaattatgacttgttggatggtatagttaattaaaaaaatccctcaaaattggagctgtatcacaaaccataaattctaaacgtcttaaaaattaggtaaaagaaaacaaaaccataaaaattcccagaaaagtaagtaaatatagatgtttttagtcttggggtaggacacaatttctagtatctcaccaaaagctgaaaccataaagggaaatgctgatttgactgcacgacaattttatatggcataaaataacctcagcaaagttaaaaggcaaaagacaaagtgaagcaaactacttgcaacaataaagcattacgccttcttatataaacagctgttgtgaataaaaaagaattaatgttcttattcaaacatgagcaaaggaaacagcaagtagaaaatagaataaaaaaaccaaaaccagccactagacaagaaaaaaatgttccattttcatagtaatcaaagatataaacatgacaatctaaggcttctttggtaaagatgaaaaagattgacaacacctggtactgtcaggctaggggaaagggagagatggttggtccagtatttggaatgattatggaaaacttaaaaacgtgcaagctctttaccagcaattccacttctagaaatgtatcctgaggcaacattagacagctgtgtaaaggtctggggtaaagaatatgatttgtagcactgtctatggctgcaaaaaataaaataaaaaaataaaaactagaataactgcaatttaaaataccctagaataggagatcggttacatagatgatgaacaaacaccatgttgttatctgaagtggtgatacacatgtgtgcacacacacaaatgatatgtctatccaagaaaaagggaggtgtaagatggaatttttctaagaaaataaaaaaagcaaacaagaaggtatgagtgtatacttagaaaaaagtttgaaagaatatatactaaaatgtccagcaattgcctttacatgaaaattatagatgttttatctatttatttattatttgaggcagggtctcactctgctgcccaggctaaagtgtgctggtgcaatcttggctcactgcaacctctgcctcccaggcttatttgatcctcccacctcagcctccagagtagctgggactacaggtgcgtgccaccatgcctggctaattttttgtatacgtatttttttgtgtgtagagacggggttttgctatgttgcccaggctggtctggaactcctggactcaagtgatcctcccatctcggcctcccaaagtgctgagattgcaggcattaagccactgtgctgggtggatgccttttttctccttttgatttatccataattaacaaacataacttgcataaaaaaaagaaaaaggccgggtgcagtggctcacacttgtaatcccagcactttgggaggccaacacaggcggatcacctgaggttgggagttcgagaccagcctggccaacatagtgaaaccctgtctctactaaaaatacaaaaattagctgggcgtggtggtgcatgcctgtaatcctagctactcaggaggctgaggctagagaatcgcttgaacccaggagtgagctgagatagtgccactgcactctagcctgggcaacaaagtgagaccccgtctcaaaaaacaaaaaacaaagcaaaacaacgaaaaagatgaaaatgcctgttacaatgtatacgtctaaactgttgctaggaatttttaaggatggcttgagttatacacttaaaattaattcacttttctgtgtgtatgttacactttattaatttactggggaaaaaatgatagcttggttaaaaagccttccaggcaaatgttgaccatagtctagtcctactatgattttgtgaaattcaaagctctgagtgagatcaaggagctgcacaatcgagtgcgtctaagttgagtgcatcatccatagcagaccaacaaggacagggtcaaaggagggggaagagaaaacctcctacaatgatggtattttcgtacataaagtaatacatttgggctgggcacggtggctcacgcctgtaatcccagcactttggcaggccaaggcaggaggactgcctgaggtcaggagtttgagaccagcctggccaacatggtgaaaccccagttctcctaaaaatacaaaaattagccgggcatggtggtatccacttataatcccagctacttgagatgctggggcgggagaactgcttgaacctgggaggcggaggttgcagtgagccaagatcacacctttgcactccagcctgggaaacaaagcgagactccatctcaaaaaaaaaaaaaaaacttctttctttctttctttcttttttttttttaacagcctttagacattaaggttggtacgtagttttgggtcttgccttttcaaagaaatacattgcccatagttgctttgtgtcccagttgtgtgcagatctgtctctctcatccacattagacagtcaatttcctaagagtaagatttgtatcttgtctttggattacttgcagtattaaacacagcagctcaagaaatattaatcagctttaaatagaatacctactactgcagtgagaacacttctgtaaaagaattatttttgcctgtttaaaatattttaaaatacaagaccatttcctctgttctttcctccctgcctaccttccttccatctgcttaatgagtcacaggaccactgagatttctgtttgccaacacagattccacttcctcagccacctagtcattcccaacaccaggtacaatcagatcctgaaggctttgttctgttttccggaaatggttttacattgttttcagctataccaaacacataatgaatattatttgccttacctgactcttttccagtgccctttaattttctccctacatttctttctttttttttctttttttttttgagatggagtctcactctgttgcccag

SEQ ID NO: 240 - DNA, 10000 bp, Homo sapien
atgttactagagttatacattttatttgagcttcatctctttggagaaaggggaacagggatgagaggattaagttagagatggtctggcacaaagcccagagatgtggggtgtgtgaagaaggaaattcatgactagaatatatgctgaaggtgaaatgaggggagcctggatagggaattcagagataattgttggcatttagtaatgtgatttgggagtatgatcccagcgcagagcaaggaagaaggctggcaggtagtaggagtcacagtcaggaaggaagtactgctagttcgtatccagtctaggtctctggacaattgacccctttttgggtaggaggatttgccagcattatctgaccccttatttctagttcatctcctagacatcttcattgctgttgccctctggtgagtatgaatccataggatggcgtctcctctccactgaccatgtccgagtctgagtctgagactgggtggaagccatagacggatgatacataggccagtaacgctgctgaggaaaagtgtgagctcttggcctagatttggggttgggctccatctcaggctcagtctcaggctggggctccatctcggtctgggtcttggtctcggtctcagccttgggctccatttcaggctccagctcccgatccaggtctaggtccagacccagcccagcctcttgttctgattccagctccaaatccaactccgactcctcttctacaggctgttggatcttgatgaagcctggacttacatttttttggcttcctagaaaactgctgctcattttatatcttgaattgtcattctgaaatacaattaggtgggttaaaatttctaattaaatttaaccttctgctgaacgcagtggctcatacctgtaatcccagcactttgagaggctggggcaggagaatcgctttagaccaggagttcaaggccagcctgggcaacatagtaaaacttctatcttaacaaataataataataattataattattatataataataataattattattattttaaaaactagttgggcatgatggcacatgcctgtagtcctagctactcaggaggctgaggcaggaggattgcttgaggctgagactgcagtgagctgtgtttacaccgctgcactccagcctgagcaacacagtgagactgtctcaaaaaacaaacaaacaaaaaaacccagaattttaatttttgagcagtcaaggaatttcagaatacaacaggacttaaggtaccagaaccatgggttccttgcagagtagaaaatatttcttgcctaaatctacttttctgtttattattattattaattttgacacagagtcttgctctgttgcccaggctggagtgcagtggcatgatcttggctcactgcaacctctacttcccgaattcaagtgattctcttgcctcagcctcccaagtagttgggactacagatatgcaccaccacgactggctaatttttatatttttagtagagacagggtttcaccatgttggccaggctggtctcaaactcctgagctcaagtgatccacctgcctcagcctcccaaagtgctgggattacaggcatgagccactgtgcccaacctttatttatttttcattaaaattttttttaattttctttaaaatgccaatgacatcatccataaatctgcttttcatcttctttctaccttctggtttctcagttactcactattcttcagactcaatcaatttccaacttagaatttctctggcttttctagctagaccggatttcatgaccaaccatttaaaacagcaatggacttaacaacattctgaaacatcttgtcttcttgatcttacttgtcttgccaacccccagtgcaatccttgacagggcctataaggctgtgtgtgacctggcctcttgccattcttctttagctttattccagctgtggtccccgccctttgctctcaccataaagttacccagagttgcctgactactgctcagctttgtgcgtgccattccctttgcctaccttgtcctcctccatcttgtccacatccacttagtcatcaccccagattcagagccaagatgaccaggcaggaccacagcttcttttgtgttccaactacatctcattcacacttccatcatagtaccagtaacatattctttatttatttacaaacctactccttactagactctaagctccttgtggtatatgacagggcctggttcttgatatccccagtaccagacactgagcttgtcacatagcaggtgcccacaggccttgcatcagccttgaatcagcctgtaacagcattcctcaaaattaatcacttcaactttcctgaaacattttcttctcgaccaccatatgacactcttctgcttttcctccttccttcctggttgctgctccttggtctttttgctatctcctctccttctactggacttctagatgttggtatgccccagggcttgatcctgggacctttctcttgtctatctatgctctctccatagggacttttattttgggcccataattttcattaccatctatatgctgatgctgatgattctttggttataacccttcccctgatctgcaggttcataaattcacttccattcttgacatctccatttgaatgtttaataggccacttgaatttttttgttttgttttgttttgttttagacagagtatcactctgttgcccaggctggagtacagtggcatgatcttggctcactgcaacttccgcctcccaggttcaagtgattctcctgcctcaggctcccaagtagctggaatgacaggcatgcgccaccacacccgactaattttcgtatttttagttgagaataggattcaccatgttggccaggctagtctcgaactcctggcctcaagtgatccacctgcctcacctcccaaagtgctaggattacaggcgtgaggccacacctggcccaggcattttgaattcaatacacatgaaatagaacttgctcctctcctagtcttccctgtcttaaatagtagaaaacaattgacatattcaataccaagtcttaatataagaatgttagtacgttaggaaaatattttttaaaaacatagtagataatgtccatctttttttttgaccgggtcttactctgtcatccaggccagagtgcagtggcacaatcaaagctcactgtgacctcaaactactgggctcaagcaatcctcctgcctcaagctcccgagtagctaggattacaggtatgcaccatcatacctggctgatttttagttttttttttcaagataagagtctcactatgttgtccaggttgctctgaaattcctggcctcaagtgattcttctgcctcagtctcccaaagtgctgacattacaggcatgagttactacggctggctgatatgtccatcttaaaccagcatcaccactagtcttttattttttaatttttttttgaaacagggtctcgctctgttgcccaggctggagtgcagtggcaggatctcagcccactgcaacctccgcttcctgggttaaagtgattctcatgccttggcctcctgagtagctggggttataggcacgcgccagcatgcccagctaatttttttgtattttttgtagagacagggttttgtcatgttggccaggctggtctcaaactcctggcctcaagtgatccgccttccttggcctcccgaagtgctaggattgcaggcatgagccaccacacttggccaccactagtcttaatagagacacacaggatccttctcattaaattcaggagtaagacaagattcatcattattacttgttctgagaggtttagttaatgcaataatatatgatattgaaataagaattctaacaattggaacataagagattagtattatttttagaaaatattttcctatttggaaaacccaaaggaattaacagtgaaacctcttaggaatagtaaagtgattcacaaaggtagccaaataatttaataaaaaccaatgagtttcctatatgttagcaattgccagttagaaaatataatggaaatggccaggtgtggtggctcatgcctgtaatcccagcactttgggaggtggaggtgggtggattgctggagcccaggagtttaagactagcctgggcaacatggcaaaaccccgtctctgtgaaagatacaaatattagctgggcatagtggtgtgcgtctgtactcccaaatactcaggaggctgaggttggaggattgcttgagcctgagaggccgaggctgtggtgcactgtgatcatgccactgcacttcagcctgggtgacagagtgagaccctgtctcaaaaaaacaaaaaagtaaaacatataaagtatctaagattttcccatgtgaagaaagtcacaaaaccttactatgaatgaaacatttaagaagacaataaatgtagagacagttcatgtttctggataagaagaatgaatactataaagatataaattctcaagggattttatatttttaatacaactctaatgattatttcaataagatttgtttttgtggggtggggacctgacaaaagattcaaaagttggtttggaagaataaattggtgagaatgacttagcaaattttgaaatagaacactgatgacataggacttcttaaccaaatgttaaagtgtattatacagcaatactaataaaaacagtgtgatggctaggcacgatggctcacatctgtaatcccagcattttgggaggctaaggtgggcagatcacctgaggtcaggagttcgagaccagcctgggcaacatggtgaaacctcgtctcaaataaaaatacaaaaataagccaggtgtggtggcgcatgcctgtaagcccagctactcaggacgctgaggcaggacaatcacgtgaacctgggaggcggaggttgcagtgagccgagattgtgccactgcactccagactgggcgacaaagtgagactctgtctcaaaaaacaaaaacaaaaacaaaaaacactgtgatactgaagctatacagaaaaatgacatccacaactaaactagaaatacactttagttttcataagaatataatattttatgaaaataacatatcagtaggggaaagaaggcttattcaatagatggttggatggtggtatgatttgcatgagtggcttccaaaatccatccacattgtggtggtattaagaggtgaggcctttggggagtgattaagtcataagggctctgcccttgtgaatggattagtgccttataaaagggctggagggctagcataaacccttttgtccttccaccttctgccatgtggggatgctgctgagagaagatggaagaagccctcagcagacactgaaactgccaggaccttgatcttggacttctcgcattcagaactgtgagaaataaatatctattatttacaaattacccagtctcagatattttgttatagtagcactaatgaactaagatagatggcatatagcccaaaatagttagctacatagataaaaaataaagattaagcctgagtgcagtggctcatgcctgtaatcccagcactttgggaggctggggcgggtagatcatgaggtcaggagttcaagaccagcctggcctacatagtgaaaccctgtctctactaaaaatataaaaattatccaggtgtggtggcgggcgcctgtagtcccagctacctggaaggctgaggcaggagaatcgcttgaacccaggaggcagaggttgcagtgagccgagaccatgccattgcactccagcctgggtgacagaatgagactgtctcaaaaataaaaaaaaaataaagattacccttcaatacctgtatactgaaatacattctatttacattaaagagtataacatataaaaaataaaaacataaaaatctagaaaatgtgtcttatttaccttctaagagggaatgactttctaaataaaaagtaaatataataagaaaaggaaacattaatagatatgactaaatatgtaaaaacaaatatatcgagtatcataattataaattaaaaaatagagaaacttccatttatagtaaaagcagactgcataattcaaaccaattagttagtcattactaattattaactactagttaactagttgtttttttattaactaccagttaactagttgtgtgtgtgtgtgtttttttgtttttttttttagagtctcactccgtcgcccagtctggagtgcagtggcgcgatctcggctcactgcaacctctgcctcctgggttcaagcgattctcctgcctcagcctcccaagtagctgggactacaggcgcgtgccaccacgcccggctaatttttttgtatttttagtagagatggggtttcaccaggatggtctcgatctcctgacctagtgattcgcctgccttggcctcccaaagtgctgggattacaggcgtgagccatctcgcccgcccgttgtacggtcttaactgtttcagatgtggtgtctcatttcatcaactaggctttgtttaataatgatttctagtcattagataatattagataatattttagtgcccatctgttttaatttcctttttttgtttttggaaacctttaacctacacaggtactgatttgaaaatgctaaagtaggcccaggtctcagtatttttttttttttagacagagtctcactctgtcgcccaggctggagtgcagtggcgtgatctcagctcactgcaacctctgcctcccgggttcaagcaattctgcctcagcctcccaagcaactgggactacaggtgcccgccaccatgcctggctaatttttgtagttctagtagagaaggagtttcaccatgttggctaggatggtctcgaactcctgatctcatgatctacctgcctcggcctcccaaggtgctaggattacaggcgtgagccatcgcactcagccaggtctcagtattaataaaaggctgaaaattcagacttatatattattctcctttgcatttggtcagcttgagtaaatctcataccacaacaatgtaaaggtaataaagctgaggtattagacaagattatagatctgaatctctgctagttcattagtattattattcatcccaagagtgggtggggtggggaggaattctaaaggtatagctaggggagacatttagaatatttagcaactggtaatagacactaaccaagaatgctgtagaaggatccttgaggtctgtgctgggttgggcaaaccctctcttcagttagggaaatttcttgaatggaaccctgatgccatgacagtgagggcacttggctgctcagatccactgctatttaccaagtggtaagggtgcatttcaacatcccagattctggtacagccatactaaatacctttcctggacattattcctctatctgatcaggaatcctgactcccagcccccaaccacccctcacccatccccccactgccctcaatcccttcccccaacctcatgctttgtcggtttgtctgaccttgtctgtttctgagtaggtttcccgtatcactgtctcggattcatcgatgcttaactcagaggagcctatgaccttccttgacaaggcaaacagcacggcgtcgtgaacgctgaggaacagctgggtcttggtgatgccagcgtcaaagaaatcattcctctcaaatgccctgactatggaagctaaaaaccaaacccagaacacacacaatgtcagatacttggggagcagaggacccagggtgcaaaacagccctctcatagggtgaaggatactcacagtgacaccctgcaatgagtatcaaaatgttggcgttttgaaaggcattgcatatctgtggggggagagaaaaccagtatcagaaggctttatacttgctaggaaaggccttctaattagctaagtttttgtcttgttttgttttggttttttgtgacagagtctcactctgtcacccagatggagtgcagtggcatgatctcggctcactgcaacctccgcctcccaggttcaagtgatttgtccacctcagcctcccaagtagctgagactacaggtgcataccacacgcctggctaatttttgtatttttaatagagacagggtttcaccatattggccaggctggtctcaaactcctgacttcgtgatctgcctgcctcgacgtcccaaaatgctgggattacaggcgtgggccactgcacccagccaattagccgagttttaaaacccctttggcccttcacttgtctgggggtatatgtaccttgcatcccaattcagctctacaaacatttgatgagtggagttctctatgccggaaaacatctacagtgctgggaatgcaaaagagaatcagaccgtgtcatgtgagggtggggagcaggagggagagctgcccatagtctcaaggggataaacagtatatatcaagacaggacgtctgcaggaggaaagccctagcatagagacaggcacaggtgtgaggcaaacactctggagaatcatctcaaacaaccatattttggcatgatggcctagtgtttgcatgagacccccccttccccctggagtttactgagcagaggaagcaagatgtggctcagagacgctcaagtgatgcagtagggaacggaattcagaaaccctgagggtcacattcagagctgccttgcaaagttgcatttgattttagtaaaacatcagatgtttactatcagataagtaaacatcagctactgtcctcaagtttgcttcagccaatatatacactgtggggcaataaatcttgaagttcacttcaaagcaaatcaatatcgactttaatacttaagactaagtagacaccaaccctgagcactaagttaaagtgtcaaaagaaacgaactctgcttctttcactaccaagaggaaatgaagtcattcttgatcatatggcaaatcacaaagtcatttggcaaagggccacaacagactctaaatgacaagtgctggaaaaggaaagtcccatgaattaggaagaagtttaatctgagtggctgtctccaataagaatggactgatgggtaggctgagcgcggtggctcatgcctgtaatcccagcactttgggaggctgaggcaagcagatcacgaggtcagaagttcgagacaagcctggccaatatggtgaaaccccgtctctactaaaaatacaaaaattatgcgggtgtggtggtgtgcgcctgtagtcccagctactcaggagactgaggcagaagaatcacttgaacccgggaggtggagattgcagtgagccgagatcatgccactgcactccagcctgggcgacacagcaagatgctgtctcaaaaaaaaaaaaaaaaaaaaaaaaatggactgatggatttttcttaggttccagttttcaattataaagtaaatagaatgatttcttccaataaggaggcagtatacacaactacaaaggaaatgaagaaacctgtatttttagagtgcaaaagtacaccatgaatctctgaaggctgaaagtgaaaggcgtctgacattgtctccatgttggggatggaacagaaagtcatcaacatgggccaggtgtgggtgggtgctgccaaggaccagaacatatggtgcctctacaaaaagaggaggagcaagggagacaatggcacaactataccatggaacagagagaaagtatgatataaagtcagatacttaaaagtttcaatgctggacaggccacttatgagctgtgagcctcagactcttaggggaaagtatggcctgtctctcaaggcagttgtgaaaattacatgagatagtgtatatacatgtgcccagctcag

SEQ ID NO: 241 - DNA, 10000 bp, Homo sapien
tcatttctacttcatatgatcattttaattgtatttacctcatcttaccaaaaagatcatggtgagtggactcccaacatatgttttaatttgtctaacagaatgctgaatagcctgacagtagcagcctagaattttattcttgatggtcttaatcagcagcacaccaattactacatgatagtataaaaataggctatgatgtaatttctgagtgatcattatatgacataaatgtagccggtctgctttttaaaaatccagatggtaaaacacttcatgtgatttcattctgtgtgctcttgtgtccagtccccaacacacaacttctcacttcccttttctcagacaccaagggtcatggtgctgaaattttccactgaatttcctctctgtacttagtgggatggagtatgacgtgtcaccttctctatttttgctgataccagagttgcctgaattctaattatttactgagagtagttttctctgggaccaaccccaaggcaaaaagtcagaatagttaagagcatggtctatagtgtcagactgtatgagttggagtactggttctgctgagtattaattagcactgtgaccttgtgtagtcgtctctcttttccaagcctcaattccttatctacaaatagaagacaataatagtacccagcacatagagttctgtgtaaacacaagaacttagatcatctttctgcacactcagtgggagtttactgcttttggattgaattgagatacatgttcatacacctaaattaggtcatggcttttaaagacaaaattccttatcaaactatttaaaacccatggcagagtgcagaaaaacccaaccatcatccagattttagtgtgtctgtaatctcaactgttttaccaagaagactattgcaagaagtttaagattcaaagaaatccatcataccttatgctgcctattagtcttccaatgatatggccattctttattattaagaaactgaatcaaattctacttatatatgcccccaatataatcacagtaattttgcaataattatttttttctatttattaaataacctgttctgggtgcttttttgaatattttacagatattattgtatttaaaatgaaaaccttatgaggtagactggtatggtttgaatatgcatccccttcaaaactcatgttgaaatttaattgccattgttacagtattaagaggcgattaggtcatgagggcttcaccctcattaacggattaatactgttataaggaagtgggttcttacaaaaagttgagttccccatccacctttttctcagtcccctaccaagggataattatgcaagaagtccctcaccagatacagactcctcaaccttgaacttcccagtttccaaaactgtaagaaataaatttctgtttttataaattattcagtctggggttttgctatagcagcacaaaacagattaagatgaaggcatattatagatgagaaaactatagcccagagagaataaagaattgctcagcatcacctagttagacaagaacagagttatgattcacactcaggcagcctgacttcagagcccactcttaacctctaagctccttgataagccataagattttttctatggtgacatatttttcaaacctaaaattgatctgactagtgtagatactgagaaattcagagacatggtcaacacaaaataggagttatggaaatgcattgcaaataacttcttaggggtaagataggagatgatttttttaaaaaaataattaaactctattagaataacataaattgtctcataaaacatgtaactgtctatagctgagagtcctttacaatgagaggtggtgaaggatgtttttaggcagacctgaaaagtgcatgggaggagcaagatttgcctctcctggactatggagaagggctgtggaatgccagtgtctgtctgggtcaccagagaaaggttaattgaggctgttttgtagggctggctgggtaggcagatctgatgagaattcactaatccctggtggctaaacagaatcctcctgcttgcttactgtggtggaaaattcctctagtctagcacagtagttctcaaagtgagatcccccagacaagtagcatcaacagggagcttgttcaaatgcaacttctcaggccccatccaagatctactgaatcagaaactctgggagtgacacatggcaatctgcgttttaacaaaccctctaaataattctgatgcacactaaattttaagaacaactgaaagcagaaaactttttgagctctacaactagaagtaagaatattgaaatgtaagaacataggtgagagctcttcaaagtggattagctacagataaatgtaaataaattttaactcactgcgtttgatctgtttttcaattctttttgatggaaataagtcaaccaaaacaccagtcctcacccttttcctcagccacatgcaagactcatgttcattaaagtcaaggcttaataaggcttgcaacatcgatcagatgggctgcagtttatgagaaagtgtcagccagacccttccactggagaaaacatgtgagtgatggcaagtagtaagtgttaatggatggatattttaaaatctattctaatttatactttttaaaatgaaaatccctggaaaacatctgaatgcaattattattggcttgtttcaagtaactatcaggggtcttaacacaggtctgacttctgctctagagcacaagctccctgagggcaggtaccttccttattcaccagtgctcattctgtgtcaggctcaataaacagatcatgagctgaactgactggaaacctgtgaatagatcagagagcattatcctcacaagtgagagaacagaaatagaaaaaggaagcgaacagggaaactgggaacagggaaaataaatttcagagttgacaactttatcttcttcagtttagtgaagactaatagaagctctatgtgcaaatatatgcctcacagctggaaaattaggtagctctaatttgcataagttgtcattttaatgtacttgttggtggcatgaattgattaataaagtgctgcatggtgagtttgtttatcgaagcatcactgtataagagtctagctttattggcccatttggcacatttgagttcagtttcaatcatgagggaagaagtcgtccttctgaatgacagacctgggagttttcacagatattggaattatagatgagcagctcagaacaggatatttcttcccttttcttttttttccatatcactactagacatgatcaaagaataaaatcaaagatgtttgtttgcctactatatgcccttaattctaattccagaccatttgtttaataatacagatgatttatttcaaaattagagatctgatttgctcaaatagtctgcattatttttaatatatagcagacatcagtgaaatatattttgaaatttattgctcgggtccaaacagcagatagataacaacccacattataagtcatggcatctgctttgccgccatcattatctgttaaaatgtattacatttttttcaatgtgtaatcttattaaaaatagggtagacatgagagtatctaaacagaagttactcatttgaatacagccactcgttaaaaaacacccagtagcattaatccttctagctggaaagtgtttttggcccaattgattctttcatttatcattttaccaggttcacgagggaagtttctagattgctaaaagcatcagatgtgtgagataaacaattaatgaaactgagcaatgcaatgtgctgggtcattctggctgacagaaaatttccaaataagtaggcattatctgctaaaacatctgtacccatgtagctacagaagattattactggagagtgattgtgttggaaaagagaggttaaaataaataaaggagctctagaaaaatattaaaagtgagttcattcatttattcatcattatttatctatctgttttatttagagtagtataacatcttcacaaaatcattttaccccaaatcgttagttttaaaatatgtcagctaattactattttgaagtaattgcagtgaccaatatccattttccccatcttctaaagattggaacccccaatctttagctgaaattaggacaatgtaatagactttctatagtagtggccaggaaaacataagcatcctttgcaactaggtgtaactatgtaattaagttcttgataatgtgatgtgaatggaaaagggcagacaatttctgggaagaatctttaaaggacatggctcttcttttcttcttcttgtttcttcccaagtgtaaatgaacaaaatggctgggtctctagcagaatattgaatcatgccttgacctggggaatgaaagccatgaacagtagatcaagacagaagaaacctgatccctcacactggggtatacataggagccctggattaactccttccagacttcatgagagaaataaacttctgccgtatttaagtcattgttattttgaggtttttctgtttctaactacgctacttgcaaagggcaattttgttattgtttttgttacccttggcaactaataccaggactaccaagaaatactgactaaatataactgtttataatcctccaaagctggaccaaaaaaaatgttaagttataaaaagaaaagataggcatatttaactgtaaaaaatatgacaaaagttaccataagtgaattcaaaagaaaaataatagatttggtaaattaaattaataataaaagacataggattagcacacaaaatgtacaaagaacaattgcaaattgaaaagaacaagtaaatacccccatagaaaagtagacaagataaacgaaataaaaagtagacagaacaaacaattcagacaagaactaatccaaatgagtattcgaaaagatgttcaaattctttaacagagaaatgaaattaaactaacaatgaaatattacattatacctattggattgtcaaaaagttataaagaatgaaaaggcctattactgtcagtaatgcaggaaaaagtactttcatatatgactggtgaaattgttaattgttactgcctttttggaaaacaatctggcaatatctattagaattttaaatgtgtattttctttgacttaacattcccactcctaggacactttctcaaataaataaaatcatgagtaatgacacacgtacaaggatgctgattacatttttttataacggcaaaaaacctctggaaatgtcaataggggaattgttgaataaattatgatacatatggtatgatgtgaaatatcatagaatcattaaaataatgcatttgagttgtagcagttgatttggcagattttcaatgaggtattattgagtgagaagaattaggacatagaggcctgtatataattgatcttattttgttaaatgacctacaacaatatgtgatatgtctgtatatttgtttacctgaacacataagcacggagaaaaatattgaagaatacatcctaaattgttaatctggattatgtgtggggtgaataaaagcaagaaggataatgtgagtagaagggtaagagaatccaagatctaatatgggctgtagcaagaggacaaaggcaagcaaaaaaaccccaagctttatcacatgtttaacttcttgatatgtaaaattaattatatgttatttatatatgtacaggagtgtattatatatgtatgtatacaaaaacatttacataattctttaatgtttttggaagttcaattttatttttattcgacaaataataattgcatatatttacagggtatactgtaatgtttcagtatgatatatatctaattctgaccctaatttatacccagaaatactgaccatcaccttattttattttaagataatctttattgcacaaaatgatattttcattatagaaagagaagagtagaaaatttagagttgcaaaataatttttaaaagaatccataatcccaccatccagagatagccaatttggaacttttattatgcatataatcttaaatatactgtaaatactgttttataattcattcttatttaaatatcacaaacatctttaataatgaattctccttctcagaagcatatgatcttacattgtaacaagtatgaaactatcactttatatccacacatcaagtcctttcgcaaatgttcttgttctcaaatcacaccaacaaaattggtaaaggaagaagatgggggccttggaagtgagaggattttttctttcctttgtaaatctgtagcaaatctgcgtggaagatgccctcttttcctccctgtatcacctaatacattctaacatcttttatgatatcaacccttctattgagattaggaacaggaaggaataacggatgttttaaattgtgtctcaaaacaccatcgtatgaattatttcgccctcaaatagttctgtagcatctgtatagtaaacgctataaaacatttcctctttagcaattattaatcaattagtaagatttcaggtttgaattttggttctgtgaattacactactagatcaactacatgtgaagcagaacaacttgtggttgtcaacatgcaagaaatcttcaaaggggcttctatggtgggcatagttactttaattttgtcgtcaagtcaattatccatagattctatggaattcaatcatttgaatacagcaactattgacagagcttattctcacttgattgttttaaaatacaccacttactttacattaagacccttgttttgatccttattctctgttcaacccagagaagaagtaacactgcctcacatttctggggttataataatgccctaggaaaaatttgaatctccagggtcaccacacctatctaccctttagatttgtcaactaccaaatacccactaagccacatcagaatctccctgatcatgcctcatgccctttcttgggatttttttgttgttgttgatagaaccacagtccccctctgtctttccaccatcttcaccacatacatctcctattgctccccaccacctgccctccgagtctattggtgcatgtccctcccaacctttcaaaaatggaaacaggcttattactattaacagctgtctctcatttatttcaaactaaacccctcttaaaaccggtcttgttagtttcttccacaactgaacatcttgaatcctcagagctccttgaaatgcaagttaaactgttttgtctgctttatctgaactgaatcttttacaaatgtctggacacaataccacacccttttactcaggccccaagcacacctgaaaatggtttgcagtctcccaaaggccaagtagggcactttaatgtccatttcctgtgaacaaaaagccagccagggcgctgtatctattgcttcatctcatattgcctgggatttctgtgaggttactggtgacttcagtttacccatttacaatcactggagattctaattaaatctcattcctgtatgaagcaacaaagatcatctcaattagactgccatattgattcattttggtaaaaattgattgggtataattatacagtacttgcttcagcatttcttattagtttacttctgccctcaatgctgttgtaataggcttcaggagaggtgtctctctattcttttattgctcagtgggaaatggttaataaattggtctgggaaatagttatgcagaactgacccatgagtagtgagaactgatcgcatgaactatttcctataactcaaagagtttccttttttttttttaacatcatttcccaaaagtcattttaaaaaagttcagaaagtcctttgctccagaaagacattttcaggttttgtaaaaagcttataagtcctaagaaagtaattcaaagtcaagggtcgactggctaatctccccttttgtagcaatcaattagctgtttgcttcacctagacactcagtaaaagaaaattttctcaatgttgaaagaggcaaatagaaatacatttccttggatagacaagacacttttaaaaattacacttttgggaggggggaagaaattaaagaaccaaatgagatgtatgagataaaaattatatattataattattacaagaatatattttgaagctcaacatctaggctcaaatcttgtctcccaaaatgactagcttatcacctctgcctttgtttccacatctgtaaaatgggaataataaaccctatcttacaaggttgttatgaggattatattaactcacatatgcaaattgattggaacaatcacttggaatataatccacccttaataaatattctttcttagtattctcagaatagcctaaataaatagtagatatctatgattaactattttcttggcgatatggaaaatgttgagacccttaacttaattgctccaaatcactggagagatagcactagagcccaagactccaaaattgatgccaccagagacggtgttgctgcttctcttttaatattgtctaatcctattatgtagcaagcatttgaggaatgagttaaattagtctgcggattttggttatagaaatgggatcgttttctgacatctcatacccttgcctcagagacatttggggtgccaaatccagatccaagggttcaacttcttaaaaaccagtagacaaatttagaaacaatggcaaagttgactgaagctgtcatccttgaccttgacaagagtgtataaagtcttgactcagcactggtctgcccatttcttttgatctttccaaggtaggtttctatctctcccttttccaccaatacattgaatagtgggtattaaaaacaatttgctatttttactgatagttttcgcatgggggttgttatacgaaacaaaatattttaagaaaaagatggtgtattcatagaatagaatagttgctctgaggtgagaattttaacagcaatttgttttactttcggtataatcttttggagaatgtatgtcttttacttatcatactgaaaactatattgacaagtcttggtccctgctagacttaaatcttgaaacagaagccacatcttaattattctagtatcccaagcattttgacaattcttggcacttattgaatgttcaaaaaattgttatatttaattgaactggaatacataatattctagttttattttagataagtgtatctgaatatctattatgcaaagatgttgactacaattgtacttagttaaaactcataattatcctgagttaagaacattcagaaaatatgaaaccaataaatcgatgaaaataatgctattaataccttgaatttatatatcatcttttagaatcactaaatatatttaatgcatgtattttgtgctgaataacagcacctgcaattctaaagtaagtgttactctattatgcagatcgtgggtcactgaccctaaggaatattatcatgacaatgttccatttcagctaatctttattccgttgactgtggtattaactagtattttataggagggtatatttgccttgaattctgaagcacaaaagtatagccctcgatcttagtttccttcagtttctcttcatagagctatcatcagtatttttctctcaactctgctcaaaactatccatactttcagcctgctccattgttattggttggtgaatgtgagccaatcatgtattttgctggtccctgcatactcacctgtaaaatatggagcaatgagccagctgttattaaagaacttttagttctaagactccatggattcaaaaatcttggagcaatacaattcagatgtattgacttaaatacctttatttta

SEQ ID NO: 242 - DNA, 10000 bp, Homo sapien
tggcataaaaacagacacataggccagtggaacaaaatagagatccccaaaattacttcatatatgtatgaaagtacatacctatacgtatgaaagtacatacatatatgtatgaaaactagatattcatatgtagaagaataaaactagacatacacctctcactctacacaaaaatcaactcaaaatgaatcaaagacctaaatgtaagaccccaaactataaaattactaaaataaaatgtaggagaaatacttcaggacattggttttaaaaaaacactctatgaataagagcccaaaagcataagcaacaaaagcaaacaaatggggttatatcaaactaaaaactttctgcacagcaaagaaaacaatcagcaagtgaaaaataacctacagagtgggagaaaacatttgcagactattcatctgatagggaattaatattcagaatatacaagaaactcaaacatctccacagcaaaaaatcaaacaatttgatttagaaaatgggcaaatgatctgagaagacatttcacagaagacatacaaatggccaacaaatatatgaaaaaatgctcaatatcattaatcattagggaaatgcaaataaaaaccacattgagatatcatgtcactccgggtaggatgcctattatcaaaaagacaaaaaataacaatggctggcgaggatgtggagagaagagaactcttatatacaattggtgggaacgtaaactagtaaagtcaccatggaaaacagcttggaggttcttaaaaaaaaactataaatggaactactaccatatgatccagcaatctcactattgggcatttatccaaaggaagatcatcagtatattaaagagacatcttcacccacatgtttattgcagcactattcacaatagccaagatatgaaatcaacctaggtatccaacaacagataaataggtaaagtaaatgtggcatatatacacaatggagtactattccaccataaaaagaatgaaattctgtcatttgcagcaacatggatggaattagaggacattaggttaagtaaaataagtcaggaatagaaagctacacactgtatgttctcacttaaatgtggaagtgagttaaaaaaagttgatgtaatagaagtaaaaagtagaaagaaagaaagatatgagagagtgggaagggtacggagaacagaggggtagagagagatttgttaaagaatactaaattacagctagataggaggaataagttctagtattctataccattgtaagatgactatagttagcaacaatatattacatagtttcaaatagctagaaggaggattttgaatgttccaacacaaagaaatgataaatgtttgagatgatgaatatgttaattaccctgatctgatcactacacattatgtgtaagaaacatcactatgtaccctatagattgtgtcaattaaaaaaagagagaaatgatggcagaagtgtgtgcttgagtaagaattttcttgcatgtaaaattcttagttcttgaatgttgacatggctcctctctagactttttacctttttaatggtaaaaagtcagtgggtccatattcggggctcttttttatgactatacaatctaacttcccttgggtcatatgatatttcttgcatacaactgagtctgaggatatacactttatattttcaatgcatataatttcagaattcataatgtatctgatgacataaaatcgattctgttgctaaccagttgtagtgctcatcccaaggaagcaagattagaattagatgatgggaaccattttaacaatttgctctttcacaaagctacctcactgatgcagtttatgaaaaaggccattgtttcagaatgtaatctcttaattgtagaattgatcctatggaaaatttgatttattataagggattgtgcagaagtttcagtcttgtttgttaggacaacattttaatactttcacctaaaattttgttcagacacttcagaggagcttgcttggtctgaacttttgtgatttatttagaatatcttattctaacttgagataaattaggaggctttttaagtcttatgtttcaaatcatagtgcagaatattttaaaaattgttatttttcaatttatttttgaatctctaatgctcatggtacaaaattcaaccataatgactaggtagtcagtaaatcttttcctttctcccttgaggagaccaccagttgcgtgtaaactatgaccctctaccccaatgttggcttactatacaggcaatctttatcttgcatggtcatgcataaaaatgtgtaagctggccaggcgcagtggctcacgactgtaatcccagcactttgggaggccaaggtgggcggatcacctgaggttgggagttcgagatcagcctggacaaaatggagaaaccccgtctctactaaaaatacaaaattagccgggtgtggtggcacatgcctgtaatcccagctactcgggaggctgaggcaggagaattgcttgaaccctggaggcggaggttgtggtgagccgagatcgtactattgcacttcagcctgggcgacagagtgagactctgtctcaaaaaaaaaaaaaaaaaattgtttgaaaatatccacttcttgttgtagactcttactgtacacacaactataaacatttttcctatttaaatgaaaaaggaaaaatataataagagatttgaaaagtctggacatttctttcccaacagatattaaaggcaacatcttcaaaataagatattatactgaaaggactattatattttaaagacaagatcactgcttcatagtttctctttaaaaaatttaaaaaactatatagctgtgttaatcaaaatgcatattttgtacaatgataatgatcttgaatttttttaaaaaaattatgataagctacaaataccaacaaaacaaaagtatctggagtagtctgtataggatctctttggactttcttttattatgttgaaatagtggtgcttttacaatttgcattattgtactctccaatacaaagcatggggcttgttcaagtatacagtacaccattttcatacatgtacaacattggtggatgaagaatgtctcttagcagtaatactggatgtagcctctggttttaccagctgcatactctaggactattagataagtaaaaatctctcttgtgatactggaaagttattagaatgtgcaaactgatatggtatctttcatctctctcttaaagggtatcaccacaggagagtccacttaagcctttggtaggtttaacaaagttggaattgctcaggcactgttgaattgggcaacattcttcagacctggctcagagctacagtgcatttagtatattaaagcagctgacatgatgactttttgcaagccttcccaggcactggagttttttctgttaattgccacactaggtcataaaagtctcattaactttttttttttttgagacagagtttcactctttttgcccaggctggaaaacaatggcgtgatctcagctcactgcaacctctgcctcctgggttcaagtgattctcctgcctcagcctccagagtagctaggattacaggcatgtgccaccacgcctggctaattttgtatttttagtagaaacagggtttcatcatgttggcctggctggtctcaaactcctgacctcaggtgatccaccctcctcggcctcccaaaatgctgagattacgggcataagccaccatgcctggccttattaagatttattttttattttgcagaagattctaagaatgcacagttgttccattgtcttgctagattttgaccttgttccttccctacaactcttttatcttccaagtcacacttattaccaacaatcactgggacaatatcagtgtctttaacttaaagaatctgttctctcagatcttgtaaatcataaaatgtggactgtgctgggatggtatatgctaatacaaagccttgtccattttttatgtacaaaccctttattgctgtaaattgttctgttcctgcagtatccaatatgtcaagcatacagagttgtgcatctatttccacttgctttctgtaatatcttttattgtaggaccatgtttttcaacaaaattctttgtacaaattgtacagtcaaagcagaatttccaacagctcctgagccaagaatgactaatttatactcaagcatgatacaaattttttaaaacctagtacctctcatgctgtcaccaggtcactgcagtcagtgttgctctgtgctttctctgagttgctactcctggtgctatggtggtcttgcctctgctactgccactctggctggtttatatgcctgaataatgagttttaaaatcatatttgcacgtgtcatggtaacttcacattaaaaaacatacaatgaatgcacaaaaaaaaaagcaagaaactaaatcatatcaccagagaaaataatcttcactagaggaagacaagaatgaaagaaagaagaccaaaaaacaatatgaaaagaacaaaatgacaggtgtaagtccttacttgtccataataaccttaaatgtcaatgggctaaactctccaatcaaaagacatagactggctgaatggatgaaaaaaaaaacagttgatcttctgcctacaagaaacacacttcacctataaagatacacagagatggaaaataaaggattgtaaaaaaatattccatgccaagagcaggagtagctatacttacatcagacaaaatagaattcaagacaaaagcaataagaagagaagtaggtcactatgtaatgataaggggggttggctcagcaagaggatacaacaattttaaatatatattcacccaacactggagcacccacatatataaaagaaatattattagagctaaggagagagagagactctaacacaataatagctggagacttccacacctcactttcagcattggacagatcattcagacagaaaatcaacaaagaaacatcagacttaatctgcaatatagatcaaatggatctaatagatatttacagaacatttcatccaagggctgcagaatacacttttttttttttttttttttttttttgagacagagtctcagctcactgcaagctccgcctcccgggttcacaccattctcctgcctcagcctcccgagtagctgggactacagtcacccaccaccatgtccagctaagtttttgtatttttagtagagacggggtttcaccatgttagccgggatggtctcgatctcctgacctcgtgatccacccacctcaggctcccaaagtgctgggattacaggcatgagccaccacacccagccagaatacacattattttcctcagcacatgaatcgttcttaaggataggccagatgttaggtcacaaaacgaaccttaaaacattaaaaaaactgagataatatcaagcatcttctctgacaaaaataaaactagaaattaataacaagagaaattttggaaactattcaaatacatagaatttaaacaatatgctcctgaacgatcagtgagccaatgaagaaattaagaaggaaattgaaaaatttcttgaaacaaatgataatgaaaacacaatataccaaaatctatgggatacagcaaaagcaatagtaagatagaattttatagctctaagtatctacatcaaaaaaaaaggaaaaacttcaaatgacaatctaatgatgcattttaaagaactagaaaagcaagagcaaaccaaacccagaattagtagaagaaaagaaataataaagatcagagcaggacaaaatggaaaaaacaaaaaaaaagaaacaaagttttatttttttgaaaagttaaacaaaatggacaaacctttagccagtttaagaaaaaaagaaagaagatcaaaataaataaaatcagaaatgaaaaaggagacattacaactgatatctgcagtattcaaaggatcattagtggctactctgagcaactatatgctaataaatggaaacatatagaagcaatggacaagttcctagatacatataacctgccaaaattgaaccaggaagaaatccaaaacctgagcagaccaataacaagtaatgagattgaagctgtaataaaagtctcccagtaaagaaaagcctgagacctaatagcttcactgctgaattctagcaaatatttaaagaaaaactaatacgaatcctactcaacttattctgaaaaacagagaaggagggaatacttccaaactcattctatgaggccagtacttccctgatactgaaaccagataaagacacaccaaaaaagaaaactacaggccaatctttgatacatattgatgcaaaagtccacaactaaatactagcaaattgaattcaacaatacattagaaagatcattcatcatgaccaagtgggatttatccctgggatggaaggatgattcaacatatacaaatcaatcagtgtgctacatcatatcaaaagaatgaaggatcaaaagcatatgatcattttaattgatgctgaaaaagcatttggtaaaattcaacatccttttatgataaaaaccctaaaaaaaaaaactggggatagaaggaacatacctgaacataataaaagccatatataacctacccacagctagtattatactgaatggggaaaaactgaaagcctttcctctaaggtctggaacatgacaaagatgcccacttcaccaccgttattcaacacagtactggacatcccagctagagcaatcagacaagagaaagatattaagggcatccaaattgtaaaggaggaagtcaaatcatccttgtttgcagatgacatatctcacatgctgagaaacctggagactccacaggaaaactagcagaactgataaacaaatttagtaattcagtagtagcatttctgtatgtcaagagtgaacaatctgaaaaagaaatcaagaaagtaattccatttacaatagctacaaataaaattaagtatctaggaattaaccaaagaagtgaaagatctctgtaatgaaaactataaaacactgattaaagacattgattaggacacacaaaaaatggaaaaacattccatgttcattaattggaaaagtcaatattgttaaaatgtccatactccccaaagcaatctacagattcaatgcaatccctataaaaataccaatgacactcttcacagaaatagaaaaaaacaatcctaagatttatattgaaccacaagagaccaagaatagccaaagctatcctaagcaaaagaacaaaactggaggaattacattacctgacttcaaattatactacagagctatagtaaccaaaacagcatgctactggcataaaaatagacacacagatcagtgaaacagactagggaatccagaaagaaatccacacacctacagtaaactcatttttgacaaagatgccaagaacatacactggggaaaagacagtctcttcaataaatggtgtggggaaaactggatatacatatataaaggaataaaactagacccctatctctctccatatacaaaattcaaatcaaaatggactaaagacttaaatctaagacctcaaaccatgaaactactacaaaaaacattggggaaatctccaggacattggttggggtaaaaatttcttgagcaatacccaacaagcacaggcaaccaaagcaaaaatggacaaacgagatcacatcaagttaaaaatcttctttacagcaaaggatacaattaacaaagttaagagaaaacccacagaatgggagaaaatatttgcaaactacccatcagacaagggattaataaccagaataaataaaaagctcaaacaactctatagaaaaaaaatcaaataatccaatcaaaggatgggcaaaagatttgaatagacatttctcaaaagacatacgaatgacaaacaggcatatgaaaaggtgtttaacatcattaatcatcagaaaaatgcaaatcaaaactacaatgggatatcatcttacccagttaaaatggcttatgtccaaaagacaggctataacaaatgctggtggcaatgtggagaaaaggaaacccttgtatatttttgatgagaatgtaaatcaatacaaccactatggagaacagtttggaagttcctcaaaaaactaaaaattgagctaccatatgatctagaattctactgctgggtatatgcctaaaagaaagaaaatcagtatatcaaagaaatatctgcatgtgaatgtttattgcagcactgtttacaatagctaagatttggaagcaacctaagtatgcatcaacagatgaatgggtaaagaaaatgtggtacatatacacaatggagaactattcagccatattcagtcacgtccaacaacatggatggaactggagattattacgttaagtgaattgagctaggcacagaaaggcaagcattgcatgttttcacttatttatgggatctagaaatcaaaacaattgaattcatggacaaagagagtataaggatggttgccagaggctgggaagggtggtggtgggtggggtgggggatgggagatggggacagttaatgggtacaaaaaatgtagaaagaataaataagacctactatttgatagcacaacagggtgactacagtcaataataactgtacatattaaaatgacttagaacatacttggattgtttgcaactcagtggataaatgcttgaggggatggacaccccattcttcatgatgtgctcatttcacatggcatgtctgtttcaaaacatctcctgtaccccataaatacatacacctactatgtacccacaaaaattaaaaaacaaacaaacaaaaatccaatcaaaagacgttcagctcaaaacaaaacctcatgcatgtgttactcatagggagaaccttatatcattaagaaaaggttaagttacatttagtataatttatttaagaaaacaaggaggttggcctgttgtaccgcggtggctcacgcctgtaatcctagcacttttggaggccgaggtgggcggatcacgaggtcaagagatcgagaccactctgggcaacatggtgaaaccccatctctactaaaaatacaaaaattagctgggcatggtggcgggcgcctgtagtctcagctactcgggaggctgaggcaggagaatcgcttgaacctgggaggcggaggttgcagtgagctgggatcatgccactgcactgtagcctgggcgacagacagaaattcagtctcaaagaaagagagagagagagagagaggaaggaaggcaggcaggaaggaagcttgtacaatgtttccttctcaaagcagacacttgaacatatcttaggtttctggtaactagtttcagctgtctcgatagacctgataagtcagtattttagttaatatgtagtaaagttctgagagtactctaaccaacttccttgtttttaactctctcccagggtatttgtctattaatttcagctttgtttgctcttaaatttaaaaatatgtatttggcttctgagttctgttttctctctcagttgcattgcttgatttgggtgcctctatttttccaataattctttattataatagtgctactgtttgctaaagcatacgtggtcaaaacccaattccctgcagagctgaaaagagctcagagaagtaaggtggtggacgacccactgaaatgttccagtttcagactgcatgtgtcacacccttgctgaaatacaattcgttttctttaatttccatgtgaagtgcacttctaagaactaacctttagtcactgggtgactttatgggagtaaaaggaagctgttatgaaatagctcttatgga

SEQ ID NO: 243 - DNA, 10000 bp, Homo sapien
tactttgtggtgttgggagtatagattatgtttattttctctataatttccagggttttccaaaattttacaacaaacatctataattttatgaacactccccatcttatttttaaaaagaaaaaagttggggggcagagaaatgcccagctcagtactgagatccatcaagtgaggccagccggtatctgtcacaccaggcagaggccccgtgctggaagccctggaggttaccagctccaagcctggtatccaaggcctcctgggcagccttagcctcctccttccctttcctcccaccagaccctgctcctgggatgtccttctcccattaccaccacaaaatcggactaatttttcagggcccaacaccaattctgctaatttttttttggctcaatcttggctcatcacaacctccgcctcccaggttcaacggattctcccacctcggccttctgaatagccgggattacaggcacctgccaccacgcctggctaatttttgtatttttagtagagaccgggtttcgtcatgttggccaggctggtctaaaactcctgacctcaggtgatctgcccgccttggcctcccaaactactgggattacaggcgtgagccacctcgcccagcctggatgaaggtgttttcaaagccctacctccccctgttgggacgaccctctgtctccctccttggaccactggcggcactttccttggacctgctttataatctttatcatgtcctgccttgtcctggagttgtttgcgcccaggtctgtttctcccactggactgaggcctctttgcaagcagaacctgcttatcagctgcctttgtgttcccagctccatcctcagcctcccacatgctagacttcaggtgtctgttgaacttacatgaattgaaactatgggatcctaaaagaggggtgcgatgtatcagtttatggcagggctcatggcccttggcacttttgacatctggggtcggataattctatgtggtgggagctgcagtgtttagcagcgtacctgacctctacctatcagatgccagtactgttagatagccccagtgcatccgggtctcctactccaggtccagggttcatcccgctctcctggaagccactcaggaccccagaaagatctttgcttctccactttggtgcatccgctccacccccaccctcacatcctgggttctatcttgtcccctttccttctgccccacccctgtagcctgtgccaggctgtgaccctggtacaggttgtccctactggtccatgcagactagactcagactgtgcctggacacacgctgtcacatgctcttcagctccttgggctcgtccccgtgcttgaacacactgatggtgacctggcccgtctcggagccatacttgttcttgacgaagacgccgtagcggccgctgtcttcactgttgaccttctcaatggtgatggtgacctctgtccccctcacttccatgcggtatcggtcaaggaaggtgacaggctggtcattcttcagccaagagatttcaggggtggggtctcctgagacgatgcaagtcaagcacagggtctgtttgaaaagacaggaagggaacagtctcacctccttgtaacttgaacttagcatttgctttcatgcccccagagagctcccagctcaggttgctccctgtgataatttagtacatgtgttttattataatttataaaggggagagattttattttaaccccacatccttcatcctcaaccttttattttattttgagatggagtctcgttccatcgcccaggctggagtgcagtggcatgatctcggctcactgcaacctctgcctcccaggatcaagtgattctcctgcatcagcctcctgagtagttggggttacaggtgcccgccaccaagcccggctaatttttgtatttttagtagagatggggttttgccgtgttgatcaggctggtcttaaactcctgacctcaagtgatctgccctcctcagcctcccaaagtgctgggattacaggcgtgagccactgtgcccgggcattctcaacctttctacaggaatacttacccatcagaatctcagaccataattactctcgcaattatcggtcccagaatggccttcactttgttttattgctttttgtaatatatatgtcactacgattttacaatgcaagtaagattatatagatttagtgcataggtttatgaattaaaatagaaaattactgaacaagctctaatgcagagcactataatgtaattattaaacacacaggctctggagttgggcttcctgggtgtgaatctcagctctgccccttcaagctgtgtgaccttaggtctcttaacctgggttaagggactctgggtttcctcagctataaactatgattagtaataaataaaaccctatttcatgtgattaccttgatggctaaagaagctcaaaaagataatatacatggaatcgtgcctgacaaaaagtaagcaccatcaataagtcagcaattgttttcaggaacactagatttacataaataagttcagtcctagacgggcttttagggatctcccagtagacatttcttttggacgctgaagtccgcaggtagaagtctaggatgcccagggctgtctagacagatggagatagaactaggtcaagtacccactgagggctgacaccaggcccagtgactttcctttgtaccacatgtcatcaatgaggtgtggtcacttggccactctttggctttgaatccatggtgctgcattgtttcgtgatctgtggtggatgcacgaaggaacacagagggggactgctggctgtgggctgggaagggtcagtaccttatcttccatgatagtggccacatccggcagacctctcaccactttggcacgatctggaagggaaataagagaccccagcgatgaatccttttctgccagccgcttcccagaagtttcatagagttgaggtttatttttaagcaaggcttcttttttttcctttttctattttcattattttggatggaaatcttttttaaatttttttttcaaaattaattttttgagacagggtctcgctctgttgcccagggtggagtgcagcagcacgatgtcagctcactgcaacttttgccttccaggctcaagcaatcctcccccgctcagcctcccgagcagctgggactataggcatgcatcagcccgcctagctaatttttgtatgttttgtagagacggggttttgccatgttgcccaggctgggcttgaagtcctgggctcaagcaatcctcctgccttggcctcccagagtgctgggattataggcatgagccgccacacctggccttggatggaaatctctagaactgtattacatgcttccttgtattcataagtagaagatatgggacatagtgtgtttctgccactgatctgaggtcatttgctatgattggtggtacctggaggtgaccatgagatgctcctgccctcaagaaccaggaagaaggtaagtgggactctgagacttcaactggcaaaatccatacaacgggtgtgaccaacaaggtcagagaaagcaacagaacctttcgcttttgtctgaaaaaacagaagcttttgggacactttgaacctggtcaagcgagggacctggtggccattgtgggtggccaggaagagtgtggttgtcaaccactaagcagaaatctggtctactcctcatggtgcaggggaagctgtgggaacaggatgggtggtcagcacggcctagaccagggatcagggacgtgcaaagagcccgatgcggatggtgtctgtccagtgggtgaaaggggagcaggaccccagatggggaggggaaggccccacagatggatgcagttgtgggcagaaagtgtcaccaacccttcacagctggacaaaatgattgtttccttcagctctgatgccacatgccccagcaacccagtattggtgaattcagctttcctctattagggtcctggacggggcttctgttcaggatgacgcattccactatgggcagggacattctcactgggtgaatgattagattcatggtacaagagcctcctcgtggcctgaggctgaggctggtcttgggctgtgctccctccaccgaggcgcccctcagccccctgcaggagcttctcactgcatggccacttatacccctcaattgccccttcccaataacagctatgagcctgaggcctgcacttcctgtcaagtggggacactcggggacaatgatgccacgcagagcgaattatcccctcccacacatggcctcaagctggcggtgtgagttttcttgtctgttcttagagctgtgctgtctccttctatggccacacctgtgctctgctgcctgcccgggtctttccctcactgaaatccttactcctcatctgctgggccagtgagagcagacagccagactcctaccaccaggccgcttagaactggcttgggttgggaggtgatgaatgggacaagctcgagctcatggacttggtggtggctccccgggtggcccggaggccgtgccatgtgcctctgggtttggggcttcatcctggattcgatgaggctccaatacctcgagagccatagcttcagctttaaagtcaccccatccccacagatcactcgggaaggcctgcccagcctcattcctgtctgtcccctccttttcggtcccaccaatgtagtccatgtgcctgcgagaaccaggctcgcgctggatgcttccacaacacaatcccaggtgtcctcggattctgtctctgtcttgcccaggtcttccctgcagctctgtaagaccctagagccccacagaccccactgtggaatgaggccttcagcagcccaccaagagggttgagcttccaggaagtttgccccaaattcagaaacaaaaacaacagaaatatcggccgacttactcttctcgatgatggccaaggttctgaaaaacagaaatgggaacaaggtgtgacattccacttgctaaaggacagtccagcccaggtggaggtgaggggtgatgaaggaaaggtggagctggctggggctcccaggaaggagtcctgagcctagtttatgccacaccctgaaggggcctataattcacactgagaaatgtagaggaaacttacttcagtctctggtgttcagccattgcatcctcaaaagctataagaaggacagaggagaatgggggccatcagggcctctgctgtctgatgatggggacagggtgaccctgggagcaaagcttatccctgactgtcctccactctcctccccatgccgatgtttctttggggcagtggcaggactgcgtgggagggtaggcgtaccctcagaagaccatgggattttcttttttctttctttttatttagctaaaaatttttaaaaaatatttctttccttaacacctatcccagagtaacctttattattattcttttattttttgagacagggtctcactctgttgcccaggctagagtacagtggtgtgatcacagctcattgcagcctctatctcctgggctcaagcaatcctcccgcttcagcctcccaagtagctgggaatataggcaggcgtcaccatgcccagctaaattatttttagtttttgtaggaatgttgcccaggctggtctcactatgttgcccagactggtctcaaactccagagctcaagcgatcctcccacttcagcctcccaaagtgctgggattacaggactgacccagcgtgcccagactgtccatgggattttctaagcaggtttccctgcagacataggtggatggctcaccttgccctgagagatctgttgagagctgccggacttccttccctgcagctatttccagagtgtatttgcccttgtctgagtctttggggtccaggatgtgaagccagatctcatccagggtggtgcccgtccttatccgatcaccactctccagacgtttgtctctgaatgtgagggtggagaaatggttaaggctgcctgtctgcaggtcaacagatacccgtgccccaaaatcctctcctctggttttgttttgagatcacgggctatgggtggtgactatgaggcaccagataaatatccattcacttactcattgattattcaaccctccattcctcattcaatactgcattcattcattcattcattcatcattcctagagacgctgtcctctgttcccagtgttgtgttgcagaggtgacacctctctgcttagtcacagggctcagaaactcgctgggggaggaacctattgtcctgaaattccatctgttcttggctctcactcatttgacaacctggaccaaattagtcaagccttctccatagagtgggtgcagtaatgtctgctccacaaggctgaggcatgcagctggtaaaaagcactgggaaaactctgctgttggattatctggggccactcagagagtggctgagtctctgtgggtacctcatctatcctgccttcaagccctggctctcagttagtggccagccccacagacccttttcctgcatgtttcccctaagcctggctgaccaagtttgctaaggctgcagaggcccacaagggtcccctgacccacctgaccacttggctcttctttgtccctgcatccctttctcccccagttcccagctgctgcccagagactgatcctgctgtggccatagagtttccagaaaaatgttgtcccgccaaggttcccaccttccctggggatctcggcaaagcctttctactcctcccactgctaatctctatcctcaactccttctgtggacagcaagaccaggaagagactctgtctctgctaacccctgggaccaggctctgcttgggggaccagactctgcttggaggaccaggcagggagaagggagggaggcccccatgggtcaggtgctgaatcctttccagcctggctggggttctggggcaaggcggacttacttgtggaaccaggtggttttcatgtactccacgttgtagtacttgaccttgctgaagatccggatcccttcctcggtcccctggattttcagtggagttgcagagagggctggggagacagaggagaaggatgaatcttccctgaggccatttaggcatcagattttggggccggcttgtctgcctctgccctggggggcaggtgctgtgggggaaatgcagtgctgtgaagaggcgggattttctcttcggtgtttgaggttagaaactaaacccacccccaatagccaaggccagtgttaggctgcttggaggctgttgggcatcagggcagggcagggctgggcaaagaggcaggctgcttaccaccaatcctgcccaactcggtgaagatggcatccagggctggcgggaaacagagagaagggttagctggcatagggctcccctagggatgtgctaggagtggggacatcctagaaaaaggctggtggagcccgtgagctgctctcagggggacaggcaactctgtaggatgactctcatagcttggggataggagggggttcagggcactcagcaatggggtgggcagaagggcactatggatggaggacaaacatgcaaatctgacagtttttgcaggctgagctgatcagcctgatgaggagcctgggcccactgtgggacggaggagtgaactcaggcttcgggtctccaagcctgggctcactgtggtatactgtggtgaacgagggcatcggagtcacaccgacctggctcctgccactgactagatgtggaatcttgggcaagttacttaatctctttgtgcctcaatttctccaagtgacatggggatcccataaatcttactgcacagatcacatcacagtctgctccactgtgctccctccacagcccctgacccatcgccagctcctaccgtcacccgtgaggtccaatatggtgtcgtcctcccctcgatcgtcagaaaccatcgctctgtaaattcccttgtcctttttggacaactggaaagaaggatgagcgatggtggtgtcagcatgggctccagaaggagagatggataccaaatccggaggcctgggctctaggcctgcccctcactctctgtgtgacctcaggtaagacccttctcctccctgggcctccatttactcatctgggctgggtgagctctaaggctcctttcagctccagagcccttggattcctagctcggggcttgtctgggcctggggaaggggtggagtagggggagttgaggacagaaccagacaccttcgtttgcattcacaggcagctgctctgagcatgacatgacacagtgagcctcactttgcagagcttgtctgggcctggcccacctttcactccctgggggctcctggatggagggacccccaccacctgcagttccccaggaggaagcgtgttttctcctgcccaggacaagggggcccttttggcccatgtttgtcagccccaaattaagtctgaacaaacactcagcaaagtaagaacttgagttgtgctttcaaggcaaggtccagagatcagaagtgacctctcattacacagcaccttccttcagccctcatctctcaatacttcccaccaggaccatctccacacagtgggtttggggcaggatccaagacagaggcagctcttaacctgaggattgaggtgctgagccccaaaagtcctctcttatgtcctcaccatcccaggaagtctccaagttctcagccaaacctagggtgggtgactggagtggcttctgaccccaccttctagccttatgtctttgcattgaaacactctgagcctcagtttactcatctgtaaaatcatggcatcatccttgccctgcctgtatgctacagctgctgtggggatcaagggaggtaactcttaggaggccagaaagtttgcaccaatgggactgatgattataataaaactctgtaactttgaagcacctactggtgccacagcctgtctgaggagcttgcacagtggtggcaaaggctgacttggcatcaccctggccaggatttgggagaagaccttgaaatcattgttttcttcctagtcagcaaggctctgtttgctccagtcctcctgggcacccagtgaggccacagacatcagcagcagggcagaaaaaggttgacgtttgagagcaagccttgtgtttctctcttaaccaggccacggtccaccaaaggccatgggggaggacttggggggagaattgagctccaggcctgctttattctgcccagatctgcctcacatggagacatccttcctgtcccgactcctagactgttggggcaggaaggaggcgttgaaagagcatcccttccaacccgctcatgttgcagatgaaagctgaggtcagagagcgacgggggctagcccaagcctgcacagtcattggcagggccagtactggagctaaagaaaaaaatcagtaatactgattctgtctctattgaaaatttgggggctttaatagtttttttgcattaattttgattttttagaatattgcatacaatattatttatcttgattactgagttttttggtgcctcttaaattttgtgctcagggcctcacttgcatcaacctagcctcggccctgccctgactcccagcccagagctcttggccctccctggcttgcagccaaaggagaaagtgagccctgaagctggagccacacttgcctcttcaatgcagagaagtcccgttcccgtctctgggtcatactgaccatctggcatctctgccctctggaagaaccactgaaagcgagtctccttcttggtgttggtcacctggggaaggtggggaatgaggagactctgtcag

SEQ ID NO: 244 - DNA, 10000 bp, Homo sapien
ccggaagcgcgcccgggctcctgcaggcggggcgctgtgcgcgccgcgatccggtacgtgggcctccgggctgtcccctctgggggcggcgatcctccctccggagccccccttcaaccctcccggaagtgaggtagggtccctaggggtcccggagcgggcccactcctagcctcacccactccgggcgtgtggccgtgggccggtcgcttcctcgctcggggccaaagttcctcagccgtgaagaggggtggatgtcacaagtcaagcctccttcccagggtggccgtgaggttcgggggtggggggaggtggggatttggggtgaaactggacagaaactggcgtgctaggcaaacgggagccccgcggcggcgaactgctgactcgctctctccagagactcaggggcagggccgggctccgaaggtgtgggaccccagaaggagctgctgaagacgggaccaagggccacagggaggtttgctggggtccagatggtgaaagtgggcgctgggggtcgccccaggttggccccccgccatctggagctcctttcgtcagtgagtcccctccgagttccctttctagggcaagatagcgaggtgaagcggaagtctcagtgtgacaccggcgaggttctcttcccagcagcctttgggaagcatccccctgtttcgggaatatggcattcgggccaatcatgtgggtgatggagcccgtctcagggttcggctgctaaaggccgaactcgtaacagcagtctctgtggcgggtagtcacttgcctcttactggctcacagtgcttgacttcctaattaagttttctgttgttcctgccctctattcaaatatgaatgattccggaaccagattgattaatcctgttatttgaagaagggaagctgggaaataggaataatgatccccacacctatgtaagaacgcagtttgctaaggttactttgcagcttgcctggtcactcccatgatctaaccctgtagggaggtagagtaggggatgttgctctgtttctccgcaggagtttgaggctcagagaggtttatgggacttggcaaagccaaaactagaacctggtcccagatgcctttcctgttagtttccttccattcatcgtatcatcccaggatccccactcccttcaccgggactgcatcctcaccacctgggatgtgctatgctgtctcccgtcagtcactcctagcaagctccctggggctgcttggggagctctgagtgacccgcagaagtgagagcacttcatgggaacaaaggaggaaggaacaaaagtgggcacctgctctgtgcaaagggctgtgctggccgggttcctattctccattatgggaggtgaggggcaggatcccagatatgttcttagcagactgcctcagggcctggagagaccagggaccacgcagcccttctccagcttgtcctttctcaacgggcagcagtcaagaccagggcatctgcctgccctcatattctctctgttttaagcatttgcaggaccagggatgctgtgctgctctcccatgagccagtcaccgagtcggtctgctgcagccctttctgaacctctggccgtctggatgctccactgtgcttgccaaggtagatgatcttgccccacctggggaggacagggaggcaggcagcatccaccctggggctttgggaggcagatggaatgaggtaggcagtggactgagtgctactgggctctgcacacctgctcatcccctccccagccctgcatcctgaggccacccccatcctgatgcctcatctctccttcacccctcgaatccaggcaggtcatcacagcctgctgcatctttaaagctcctcccagcccccaccaaggggtgagcactcattacctgacacccgcacctagatgaccgccttcatgaccttgacctgcccatctccagccagccggtcacttctccgctcacaaccacagcctccattccatagcccactgctccctaacccatacactctggtcagctttgtcacatgtacctgggagtcccagagcagcctcttcaggtccacccgcctctcccagcaacctccttttcacacctgttgcactctcagtgtctgccttggcattgagtaattctgtgggaataggctgcattccttcttcactgtgctgttatgtctcctggcatttgccataaataccttgggaccagttgcaccaagttagtttgggaggaattcagtaaggaccactaagctggacatggggatgacggaacacaagacctggagatgctgtgatcctcccaagaaaactggaaatccacttgtgtgagagttacagcagagcttcctaatcattgtcatggcttagcgcacataccacatgattatatctgcgtgacaccctgaggcacataagaggatttgaaaccactgcctgaggcctcttagctgcagcagccagcctggagcactgtcctcaccagcctggtcaggctgccccaagttttagaagatcgagggtttgccgcacgcagagggccatggcacacagtgtgggaagctgtattaaagatcttccagtgggtgaatagttaagacatttcttacataatcaagcacagagtgtgtggtgtgtgtgtgtgtggcgggggggtggggaaggagatttgggagggctgaagacactggtggctgtggccctagaagctgcagcctactaggtacaggggctttaggcagcctctgttctcaccatgaacagggagagcagcatttgaatgaaacttctgtggtgctgaagtaaattcaggggctttgaggctcatcttctggagctgttttttgtttgtttgtttgtttgtttgtttgtttgttttttcagacagagtctcgctctgtcacccaggctggagtgcagtggtgtaatctcggctcactgcaacctctgcctcccgggttcaagcaattctcctgcctcagcagttatcccgagtagctgggataacaggcacttgccaccatgcctggctaatttttgtatttttagtagagacggggtttcaccatgttggccaggctggtctcgaactcctgacttcaggtgatccaccccccttggcctcccaaagtgctgggattacaggcgtgagccaccgcgcccagccctggaactgtttttatctgagggagagatatctctggactgcccagagatggaggtgcaccagtgccctccgatccacaccaggcactaactggctgccgtgagcatggcctccctgggcattcggctccatgtctaggccaagacctgggtcccttcctgtgccagtctggttccagtaggccccgtggtgggtctgttgctgtgctgagagggaccagataccacagaggaaagggccccagccttggcatcaaacaggtctgggtccagatcccagctttgccacttcaggctgtgcctgtgtcctgctctctaaaatgggggtacctgaagagttctactttgtccagttgtgagggtgcaacaaaaatggaagtcccttgtgatgcctggtgtgcagaaggggctcactgaatgtttgctgaggttggggtcctcttcgttactcagactgagctcatagatgttggggctggaggctgaccttgaccttgcctttccctggcagatgaagtgcgtcttggtggccactgagggcgcagaggtcctcttctactggacagatcaggagtttgaagagagtctccggctgaagttcgggcagtcagagaatgaggaagaagaggtgagtgcagggtaggcagtcccaggaggggtggataggaaggaaccatacaaaactcccagcaggcagagaggcaggaaaacctgtgttcaccctgtcctgggcagcatgagcagggtgctgggtggggtccagcatccttcacacctagacccttatcctcaaggttggcctcttgatgctctgagctcggtgaccccacccccacaccccaccagtcctctctggactaaatgagggcaagaagaagtcgaattttatcacgtaacagaagaacttggagccatcagtttctgtaacctaaaaagtttaacaaggctgggcgcggtggctcacgcctgtaatcacaacactttgggaagccaaggtgggccagttgcttgagctcagggatttgagaccagcctgggcagcatggcgaaaccctgtctctacaaaaaaaatacaaaaattagccaggtgtggtggtgcgtgcctatagtcccagctacttgggaggttgaggtgggaggatcacttgagtccaggtggtagaggctgcagtgagccgagactgtgcccatgcattccaacctgggcgacagagcaaaaaaaaaaaaaaaaagtttaacgtaagctgaacacgttaattttttaatagctgtattaaggtatgattaacataccataaattgcacatatttaaagtgcataatttgataagctttgatatgtatatacctatgattctatcacaatcaataaaaggaatatatctaccacctcaaacatttgtaatcccttctttcccatccccatcgcataggaactgctgatctgctttctgtcatgatagattagtttgtatcatatggccttatataaatggagtcatacagtatgtgcttggatttagtttggttttggtttgactgctttcactcagcataattattttgtgattcatctgtgttgtggcatgtatcaatcgttcattccttgtcattgagtagtaatctattgtatcaggatgccaccatttgttcattcatttacttgttgatggacatctgtgttattttcagtttttgactattacaaataaagcaactatgaacatgcacgtacaagtctatgtatacatggatgctttcatgtccaaggacagatacttaggatagactggctaggtcatgtaggtgtatgtgtaactttttaataaactgccaaacttttccaaagtggttgtgtaatttttgattccacctgtagtgtttgagagttcagttcctccatatcctcaccaacactatagtccgtctttttaattttagccattctaatagatgttcactagaatctcactgtgttttaaatttcatttccttaatgactaatgcttttgagcatcttttcatgtgcttatttgccatatcttttgcccagtttttatttgagttgattgtttcttcttcttattcttactgagttttgagagcttctaatatattttggatggaatcctttatcagatacatgttttacaaatattttctttcagtttgtggcttgtgtttgtattctcaatggtatctttcaaagagcagaagtattagaactcgagtttatccattttgcatttatggattatgcttttagtgttatatctaagaaatctttgcccaacttacaaagagttttctctacatattcttttgaaagttttatagttttaggttttatatcaggtctgatgatctactttgaatttttgtgtgtggtatgagctatggattgaagataattttttttttgcatgtggacatccagttcaacagtttaacattacaactcagaaatacttgtcattttcacttacataatttccactctacattttaaaggagtaatttattttgaaaatgttttccagattaattttgggttaaaaatatttttactggggatgcagtggaaggtgttcttacatttctgcagcatgggctgattgcctctctgtccctttctgctctaaggggtctcatcatccagccaatgagtgagctgactccacctcagggagtccatttaccatcaacatcacccgtgttctcatcacagtctttaggcaaacacaagatatcagagatcatagacattcaagtggttttatttaagctaactgttaggcttttttattttttaacagtcaatacatataatatttaaattaagaatttttaaatatttcagtttttaaactactgttacaactatgtcaacttaagaagcaaactatttggtggcctttctcttcctctttattgaaaacctggcaaaggaacgaactcctgaattttcagttcctaaaaatgagtagtgtaaaggaaaggtggtctttaaagttttttttttttgttaatgtgcaacacattcttttctcatcatataaataatgagttaattgtaggaaatttggaaatacaaagagatagtttttaaatgacctataattccatgacccagagctattagctttttaatatactttctttgggtctttattttttctatataattgggattataccacatttacagttttactgcctgtttttttttccacttgccattatatcaagatatttcttctatttttttaaatagtctcagaagcataattcttaatggaaacattgtactccagtacatgaatcagtgtatcatcctttatttaaccattttcctcatatggacataaatattgctcctaatttgctatatcactcttgctttaagaaacatttgtgcttaaattttatctcatgtcagataaattcctaggataaatttaggataaattcctaaaaataaaaatgttgagtcaaaagccattcaaagatattgtactactttataattccgccaagtaatatatgagtatgctcctttatatacaccaaatatttttatctcccctgtattagtccattttcttaccactataaagaaatgcccaagactgggtactctgtaaaggaaagaagtttaattgactcacagttcagaaggctgtggaggcctcaggaaacttacaatcatgtcaaaaggcaaaggggaagcaagacaccttcttcacaaggcagcaggaaggagaagtgctgagtgaaggggaaagagcctcttataaaaccattagatctcatgagaactcactgtcacaagaacagcatgggggaaactgctcccatgattcaattacctccacctggtttctccgttgacatatgaggattgtggggattatggggattacaattcaagatgagatttggatggggacacaaagcctaatcatatcattctgccccaggaccctcccaaatctcatgtcccttttacatttcaaaaccaatcatgccttcccaacagttccccaaagtcataattcattccagcattaaccaaaaagtccaagactgaagtctcacctgagacaaggcaagtcccttccacctatgaccctgtaaaataaaaaacaagttacttccaagacacaatgggggtataggcattgggtaaatgttcccattccaaatgggagaaattggaactatggggctacaggacccatgcaagtccaaaatccagtggggcagtcaaatcttaaagctttgaaatgatctcctttgactctatccacgtccaggtcacactgatacaagaggtgggctcccaaggccttgggcagccctacccctgtgcttctgcagggcacagtcctcttcccagctgttttcacaggctggtgttgagtgtctgcggcttttccaggtgcatggtgcaagctgtcggtggatctaccattctgggggctagaggatgatggccctattcttacagctccactaggcaatgccccagtggggactctgtgtggaggtgtctgaccccacattcccttaatcactctagcagaggttctccatgagggctctgcccctgtagcaaatttctgcctggacatcctgccatttccatacatcctctgaaatctaggtggaggttcccaaacctcagtttttgatttatgtgcacccgtgggcccaataccacatgtaggtcaccaaagcttggggcttgcactgtctgaaacaacagccagagctatatgttggcaccttttagccatggctaggacgcagggcaccatgtccccagagtgcacaaagcagcaaggccctgggcccaacccctgaaacagttttttcttcctaggcctccaggcctgtggcgagagggcctgctgtgaagacctctgacaggccctggagacatttttcccattgtcttggtgattaacgtttggctcttcattatttatgcaaatttctgcagccagggcttgaatttctcctcagaaaatgggcttttcttttctattgcatcatcaggctgcacattttccaaacttttatgttctgcttcccttttaaacataagtcccaattccaaaccatctattagtgaatgcataaaactgagtgctttttagagcacccaagtcactccctgaatgctttgctacctagaaatttcttccaccccaaatcatctctctcaagttcaaagttgcacagatctctagggcaggggcaaaatgctgccggtctctttgctaaagcataacaagagtcacctttgttccagttccaaataagttcctcatctccatctgagactacctcagcctggacttcattgtccatatcactatcagaattttgttcaaaagcattcaatgagtctctgggaagttccaaactttcccacatcttcctgttttcttctgagccctccatactgttccaacctctgcctgttacccagtttcaaagtcactttcacatttttgggtatctttatagtagcacctcactctctgtggtaccaatttactgtgtcagtccgttttcgtaccactataaagaactgcctgagactgggtaatttataaagaaaaaaggtttaattgactcacagttcagcatggctggggagaactcaggaaacttacagtcgtggtggaaggcaaaggggaaacaaggcaccttcttcgcaaggcagcaggaagaagtgtcaagaaaagtggggaagagccccttataaaaccatcagatctggtgaggactcactcattttcatgagaacaagttgagaacagcctgggggaaccacccccatgattcagttatctccaccaggtctcccttgacacgtggggattatggggattacaagtcaagatgagatttgatggggacacaaagcttaaccatgtcatcccctcaccaaaaaaaagttctattcctgcagaaaaagctatagtcatgccctgcttaatgatggtgatacattctgttaataacaaactcatcattaggtgatttccttgtcatgtgaacatcatagtgtgtgcttacacaaacctagatggtgtagccaactacacacctaggctgtacagtatggcctgttgctcctaggctgcaaacctacagcatgtgactgtactgaatactgcaggcagttgtaacacaatggaaatgtttgtgtatctgaatgaacatagagaaggtatagcaaaaataaagcagtataatcttatggggccactatcatgcgtggtctgttgctgaccaaaacattgctcttcagtatgtgactatactgcttttacgatgagtttctatcaacatctagattcataagtgacttctctattaataaaatttgttcaagaaaatcatggtatatgaataattcagcaaatatttgaattcttgcctgtttatggaattctcgcctatctgtggggtattcattaaccaaatattaattgggaacctaccatgtgccagtctctcggggtaaagcagtaaacgtagcaacatgatccttgctttcatggaacttagagtctaaagaaggacattgtacagtgaaccagatggcaaataagtaccatgagttcagatagtgacaaatagtctggagaagttaaatggggtatgggatggggagtgacagaggtggagggcggtagcctgaggtggccagaaaaaaaaaaatctgagctggaaccagaatgataagtaggagccactgtgaaagctggacagactaactgtgggagctggg

SEQ ID NO: 245 - DNA, 10000 bp, Homo sapien
ctgggagcagagcatggcccacgtgaaggtgcatctctggagaggggaccgcggagctcagggaggctgcctgggagcagagcgtggcccacgtgaaggtgcatctctggagaggggacctcagggctcagggaggctgcctgggagcagagcgtggcccaggggaaggtgcatctctggagagggccccagggctcccggaggggaggtgtcatcccataggaagtcctgactgtccagacacagccagagccacctgagctctgttcctgggcacattccctccccgagtgatgccaacagtggctgatggcacagagcacaggcttggtgcggactcgggtctgtgcactgactcccaccctcacgcgagcccgcagaggctgctgctctcctcacccccatttcacagctgagcagaccaacgcccaggcagattaggagacttgcctaaggtcacacgtggtcacacaaggtgctctggagcccacacctgaagagggggaggtgctgtcccgtaggaagtcctgactgtccacattccggcagaactctgtgccccagaaggcgaagtcgcgtcctccccaagttatgctgctcagcaacagatggttaatgccacagccaggcaccctcacaaacacactgcctacgcctgcacattcacatacactctacacaaacacacacacattcacccacacatacgcagatacactcacacacacacacgggcacatgcatggacacacacacacatgcatattcacatgcacgcacagaaatacaagtacacatatgcacacatagccacacctccatgcacacattcacacacacagacaccccacacgtgcacactcatgccctctgacacacgtgcccactctcacacttgcacactcaggggaatactcacacatgtgtgcactcacacacgtgcacacacacactgttttcccaccatcccttggacagaccccaggccaaggaggggtgaatagcgagagctgctggcaggagctgggggagactgcgtccagccctgcatccctgcgtgactccgtcggcccaagcctctccaggcctgtttccccatgaggagtgaacctggctgggccccctggaatgctgctgcagggtcgcctggcaaggggctgtggccctgggcacgccagccagccccaggccgtgcagccccaggaaatgaccccgaatgcacaagcctccttccgccgggcagtgggagagcccgggctctgggtccaagaggtcactggggggctctgctccacccccaaccccaccctgggctttagcagagtttctatcccacccagggtggaaactgagtcaatggcatccagagagcccttccagccccagccctgctacggacaggcagtcaaggttgccctgccaggcagcatccccaaaacaccaggacaggcctggcactctgtggcttccctaaccctggggatcacgcagagcccacattccaggtgacctggccccaggagacggggccccagctcagctgggcctgcaagcacaacctctcccacagccactctctgagagcaggtcctgaagataagccgcccctccccgccacccccctggatggccggctcctgccacaaccctatttgcaataaaaacctgatccggcgatagcagaaaattgctctcttttgaaataattgaacccgtccagacagtgtcctcccagacatcattaacagggcactctgcttgtctgcagtatttatgcccacttggggaggtggtcatggccaccctgttatctcctgtagaggacggcacacggctgctggagtcactgcagtatccacccaaaccactcctcccacaggcctgccctgaacctctgaggcacccatccctttgggggaccctggaggagttatccttgaggaccatgtaggcccctcactctcaccctcccccttctcagcccttgggggcagggtccttggaggaccacggggagcgagggaagcatctcaggaaatgcaaacacctgccctgtgaggggcaggggcggcagtaccctccaaggaccccagggcaggggagaacctgaagggcagcaggaggtccccacactgccccctatccagctgggagcagggcagggaggacctggcctggcatcagctcccagggaagccccagccccctctggcctcagtttcccgacctgaagcaagagaggcaggctcatcacccccagagcccttgaaaggcagacacctgcacctgcacagatgcctggtaggcactgcacccctctgtagggaggagtgcccaaaagtcaagaaccctgccaaggctgtgagagaaaattcacacttggggggctccaccggtgagcacgaatgaggagagcacagcctctgccgccaaagacacgggggtggaggcgaggaggcgccattcacagccaggaagcaaccagcgcaacagaggaggggacagagagacagagatagaggtagagagatagagagagaatcagagagaggaagggggacagagacagaaacagggagatagagacagaattagagagaggcagggagacagagatggagacagagagagagacatagaaagatagagacagaatcagagagaggcagggggacagagagatggagacagagagatagagacacagaatcggcgggggcgcggtgcagagagagacacagagagagagtgtgagccgtgctgaggggtgggcccccaggagcccaggggcgccccaccagcaccagcccaaaaaggtgagcatgaccctctgggaagcctttctgtggacccggtctcagagccctgacaattcccagtccccagccccagggcttcccgctaccgaaaggagacaaagcaaagatgtttcttgcagccttatccatgacctccaaacattgcaaatgacaatactaaaatgcaaccctcatgaatacccaatcatcgagggtgactttcagtgacgggacctcggcccagtggaatattatgcagccattaaagatgataattatgaagaccgtggcagcaaaggaaattgcttgcgatggcatttctgaacgagcagggaacaggatttacctgcactggggacaccacagaggaaaagtggtgtctgctcaacagcgtggccggtcgcaagcccgggaagccagcctggcttccaggaaagaattttctcctcctcttattttcattcctctgagtgccacttgtgcagtaaataataaataacgtctctgcttatcttaggaccatgttccagtaaatgaggactgcagcaggagccgtgagccctgactcccggccagagacacgacgtcagaccagaaagaatgaggaggccgcgtggggcccgcgggtgtgcagggcagagagggtaaggcgggccgctgggacacagcttctgcaagctggccttccactgggggctggagggggcagggagcaacagacgtggaaaggccatcctccaccccaggaatcagggggtgataggaggagggcagggggatcactgagggctggggggagcagcggggggcaatgggtgccttgaaggatttggtctggcagaggagattggaggcccccaggtggggcacagcttggcagaggaagtgggagccatggagggctgtggaagaggcagctcagggaggagggtgttggaggagggaagagggtggagagaggacaggtcaagactgtcaccaagggtcagtgttagggttaggggcccagacctcagaccctgaggctccatccagcctctgaggcactgccaggctggggcatgccacaggcacagcaggagctgggccagactcagcatgggcaggcctcacgccctcgcggggcagcctcgccagatgccgagcagcaggctgtgtacagcgagcaatgccccagccaggaacaacctcagagctggcccggctcccagggtgcctcagccccagttgtcaccatgtcacagacaaggatgctgaggttcacagcagcccgaaactcccactccatcttccagactcaggctgggcccatacacgtgagcagaccagcagagaaagggcccaggtaggcaaatgtgtaggagctgcccccgcctgcagcctgggaggctcggccccagggaaaaggaggccgaggccaccaaccagccctcctcacggccctggcccggcccctgccccatagagcttgcaaactctggccccttagccagagcccctctgccattgcagccccctccccctgtccacatgtcctggggaccctgtccagcagcctgcatccgagacagcgggcagacgaagagaggttcagtggggacttgcgtgaagagacggggtcaggaggggctcctgtcttgcctgggcccctgaggctgagtctggctgccctgcagtccctgtccaggagctgcccctcaccctacaggaagtgacaggcccagcatagcgcaccagccaggacagggtacaggttccaggacggtgctgctgggccccacatggctcagacctgggtaccagcggcctcccgccggggactcaccagtctgcttcccgcccccacaccaggaggacaacaggaagtgccccccctccatcctgaaacggagccggccggagcaccaccgcccagaggccaagccccagaggacctcgaggcgcgtgtggttccgagaacccccagcggtgaccgtccactgtaagagggcacccgcagcaagcagctgggagagggtggagtcaggcagagggaggcggggacaccggccacacccacacagctctggcagggcccaggacatgggggggccgtggccacctgccttcagtgccacaacccctgtaagacctgggcccctggggtcatctggacacacagtcccggtccatgaaacagcaactggaggagaacatgagggcggattctcaaatcatgactgtccctttgaggaagtgtcaggaccggctgggcctgggtctctcactgatgaatagtctcagggtccttcgggggtgcagggtgagacgagagggcgggggcgcccgatggactgaggcaggtgcccccagctgactctccattctctttcgcagacattgctgacaagaacgccacagccactgtcaggggtgagttctgagcccacatccctgtgccccactgccccctccgtgggtgcacccaccctcacaccctccccgagggaggtgtcacagggccagggcctctaaggagtccccagttggggagctcttgttgcaaggagaccccaagaggctagggaggggccatgggcatggacagggtggaatctccccatcccttccccaccagccccagtcctccagggaagggtcgcgctggctggcgctgaccctgcctgccctctggccgcagtgcccggccggcccaggccacacggcggctccctgctcctgcagctgtgtgtgtgcgtcctgctcgtgctggccctgggcctatactgcggccgggccaagcccgtggcaacggcactggaggacctgcgggcccggctcctcggccttgtcctgcacctgcggcacgtggccctcacctgctggcgcggcctcctgcggctctgacgggcaggacgggcaggacgggcagggcttccaggagagctcaagcactccgggggctccgagacagcctgagccctggccctgctgcttggtgaatcatgggggccaaaaggggctgctgcctgagggctaactaggaaaagggggaccccgtggcgtgagatcggacatgggggcacagcgggcggccccgccacactagtcagcacagccctcctgtctcctgtgttgggtccatgtgagattttattagaaagaggattcgactgctaacagttgaggctccccaggctcacccaaagacccctccctcgtcccagcaggaactcctgctgctgctagggcctggcccggccatcaccgtgtgcaccctcttgaggagggggacacactgcccgtgttcaaggggctgctcggaggaggcaaacccagccttttgcgattatggcttgtggggaatccagacctcgaaaccccacggggagggaagggtctggttgtcaaggtgggtccctttgatgtgaggtgccatcctctgagcccaggtctgacccccctacccagccccgtgagtctggagaggccccagggaaggacccctcatcaggggcggcttcaggtgtagaagccgaggggacagcaaggggcccagacacccccgaccttcagaacagccatctgtgcccagctctgcaggccaggcacacccagctgagcccggggccagccagcaccacccaccagctggggcctgtgggtcccggagaccgtctgtggttgtggctttgtcgccggattgcagagctgaagggagccctgtggatgacaaacaccaggggcctctccagaccctacgtggggggagggctgaacaaagcagggaggcccacggttagacaccaggcagaactgcccaggagagacacagggacaatcagaccagcgtcctcgaggttagcctgaggcgggtgggcacggccgaccatccacccggtggttcctgtttgtcccaccacttaactgggagacactgttttattaaaacacaccgtggcttccttcagtcttggtgtttttatagaaatgagagaaaccagaaccgatttgctaaggaatcggcctcagtggccaaagcggatgtcctgggcgcctggaacctccccatctcctgcaggcctgggagtggatgtgtccactcgggcaggggctgaccaagcccctgggtcttgagggatgcccggccggctccctttgccctgcagtcagggtgtgtccctgcaactccaggtgccagggaacaggtgaagtggtctccagggtcacttccagctttggaatccagggagcccagagttgcgggtggaggtaacaaaaggggctgtttccagaagtggcccagaagggaccatggtgggggctcccccggggaccctccagcatctctccccaggcccagcccatcccaccccaccccaggaaggaggatgggcaggttcctgccccatattctggatgcagaagcagcggctcccagaggttgggtctctcagagcagtcacaggcccaggctcagccctgtgtgcttgggacacccctccagccccggttctgacgggggacaccgcacaggccgatctcccccagccgctgctgtctgtccactgcaaaggcaacgcaaggacgtgcctggctttgcggggtcccacgctacgacctcaggtgttttcgaataaacattgctcaaagatgggcaccacacccccaagagatccttcgaaatggatcctcccacctggggaagctgcatgggaagcagtgagactcgaagccactagaaaatgtacagagaggaaggcagaacctcgggaaggccaacttctaattcctaaaagcttcggacacgaaaggctcaaagcctgagcaaactgtgtgtgacccacaaattacagacagttagaaccacgagccaggccagccaacagcggagagggcagacagaagccccacacgctcctcctcatccctgttggagactcgggtgcttttgtttttattttgattttgaggaatagacacatgtaagcttaaggatctttactttcagtttagccagagtggaattagaacagggatatcattaacagccagccaggacagaagcgaaggcgtctcagaagcaacttggtggaccagcctcaggaaccccgggtcatgcctgcacttcccaccttcctgcctggggagaggcccaatcccctgagggaccctggagagcccacgaccagggccgccagcccctgcccagcacactgcaggcccagctgccccttcccagggcgatgtgtctgggctccggagacagcccagtccagggtgggtctatgtctgcatgcagccgaggatttccatcaccctggccatggggctgttccacacctgctcctgggatccagcagtgcagcccccaagaacagacccaaccggggccaagcctcaggttccagaagccacccctgcctcctgcccctccttcagggccctagatggctgtggcctggatcagggctgggcagagggtgaggcaggagccaccccaccttctgctggggacacagacaaggagctctccggactggaaagagtccccatgtccagtgggtcagggctggaaggggagacaggggaccccatcagcttagggggcctcggattctgtccaaaccccttccctcgaggacctggctgccagctggaaactcagctggtccccaaggccagagcccccttgagcttccagagcctcgatccccctggacttgacacccccgatgggcacctgccagcctcactcccgggacccaggatgatgcccccaccaggaccctccatgtggacccaggcacgtggcctccaggaggctggtgcccagccacccagagacacaagccagctgctgatggtggacagggtgggtcatgaactcagggagccaggggctcgcctctccccgggaaggtgggcgcagcagcagggagcacttggcagcactcgagccaagaaacggacagcccctcatcgagccccgggtggggaggccccccgcctccgcccccgccccagaacgagtcctctggaggtggaccctgggctttcctgaggggcagggtccacagccaagcagccccctacgccggggtcccaggttcacatcccagctcctccacttgcttctgcggggcctcagcacacagactctgcagaatgggaaggcagctccctcctctctcaggtggatgctgggcgtgggagcccatgggaggggcagaggggctgtccacacagcacccacggctcccatcacgcacacaatgctcacgcgcacaggcgtgcacatgctcacatgcaacacacgcacattcacatgcacttacgcacatgctgcacacactgcagacacacctgcctagacactcacacctacacactcctcctcacactcacatacatgcacactcatgtcacagggagtcacaccctcacactcacatcctcccaggcacactcacaatcaagccttcacacgcacaacagtcacaccctcacatgcagtcacacccacatgcacactcatgcacactcacatcctcccaggcagtcactcgcacatgcagtcacacattcactcacatgcagtcacactctcatgcactcagtcacaccctcacatgcacactcatgcacactcatatcctcccatgcagtcacacactctcacatgcagtcacaccctctcgtgcacactcagtgacaccttcacatgcagtcacacctgcactgtcacacccacacatgcacactcagtcacatcctctcatgcactcatatacacaatcacaccctcccatgcacaaaggcactcacaatcacatcctcccatactcacccacacacagacccctgccatggctcctggcccagtcctctatgtggtacgtgtgcccccgaaatccccaaccagatgatgcccccgattctgtggagcccagattaccacttccctgaccctcagccaagcacagacaggacccacacacagtgaggtgaactcacaggcctcagaagcctccctgagcccggccacagggtctcccaggcctatggcacccacccaggagggggactcagctggggagggggccaacctggggccagaggctggaaggtgccgtgagctcctccccacacgcagcctctgcctggatggcagaattcatgcagaattcgttcagggctaagtgacatctggccacccctgg

SEQ ID NO: 246 - DNA, 7008 bp, Homo sapien
tgacctgatcaataaggtctttattatcaccagttagtgcaggcaaggtaggtgattccagtggagggtgatttgtggcctcaatggacacatcttaggggttaaacacagacttgaccacatccacaaggaatgtgcatcttcctgagctcaaattagatttccctcaaggcccctcaaccagcatcggttcagctgagcacagtcctgaatccctagagaacacaggaaggaaggctcagggtactgttttccccatgcatgaggacaggactgctgcaaatttttggatccaggcaagatggaaagtgactatggcttctgccttatgctgcatgggtgagatggccctgcaaaggttcctgggctggtcagaaacagagtagcttctgaaggcttttccacattagcagtacatgtaggtaatttttctggtatggggattctgctgcatgaagtttgacttggctgaagattttctcacaaagaccacttccataaggctccactcaggtatgaatctttttatgctgtgcaaggttacaaagatggctgaagagtttcccacactggctacactcataagtcctttctctggtgtgaactttctggtgccgaacaagtgtagatctttcactaaaggcttttccacactggatgcactcatagggcctttcttgtgtgtgaactctctgatgacgaaccaggtgggagttactgctaaaggctctcccacattcactgcattcgtaaggcctttctccagtgtgaactctccagtgacaaataaggctggattttcggctaaagaatttcccacattcactgcatttataaggcttttctccagtatgaactttctgatgcttaatgagaatggagttttggctaaagaatttcccacattcattgcactcataaggcctttcttttgtgtgaactctccagtgttcaatgagagtggagctgtgagcaaaggctttcccacactcactacactcgtaaggcttttctccagtgtgaattctccagtgctgaatcaggctggagctgcggctgaaggatttcctacattcgctgcactcataaggcctttgcccagtatgtactttctggtgctggatgagggtggagctattactgaaggctttaccacaatcacagcattcaaaaggccgttctccagtgtgaactttctgatgtcgaaggagatgggagctttggctgaagtctcttccacattcactgcactcaaaaggccgttctccggtgtgaactttctggtgctgagcaaggttggagttattgttaaaagctcttccacattcactgcattcatacggtctttctccagtgtgaactctccagtgctgaatgagagcagagcttcggctgaaggatttaccacattgactgcactcataaggtcttacctgtgtgtgaactttctgatgccgaaggaaattggagctttggctgaaggctcttccacatttcaggcactcaaaaggcctttctccagtgtgaactttctcatgccgaatgaggtgtgatctgttactgaaggctttcccacattcatcacactcataaggtctttctcctgagtgaattctctgatgatgaacaaatgtgagtttgtggttgaaggttttcccacatgcaatgcactcataatattttacttcagtgtgaaatttctggtgcttcctcagcttagatgagtgactaaaggccttcccacactccttacacacatggggtatttccccagtgtgaaattttttattaccaaggattgatttctcctctaagaaatttccacctgttgggcatgtaaatggtatctcttcagagtgagttctcagatggttggggagagtggagctcttcaggaaggcttttccacagttgctgcactcgaagagtttctgtgtggtacagacttctggaagctgcccaagattggaatatggcttctgcccactgtcaacagcttgaagctggaggaggtcacagctgcccaggatgaccttcccaccttccctgcaagtgaaggggttctctgacaggtggactttagagctcttcataagtgcgtccctgtccttgtaccatctaaagggcttccctccactgtgctccttctggtgctggtgaaggtttgcattcaaccaaaagtctctcccacatgctccacatgtgtagggtttctcctcagactgtgttccctgatgctcagccaggtgcaaaatgtctttcaagaatggcccacacatgtcacaggagttagctttcttggtggaaggatctgcattagggatcctgacctgtaacacttctacagaaacattctgcttgggatgggccccctcaccctctactccatgccaagaacctgaaagtagagaaatgccagttaactaagaattccacttggtgggaatggttgacttcattagaaatgttacccaggaattcacacccaagaagaggtcccagggattgctgacaggccaacagggccatcatcagggtgaagaagggcccattactattggcaggatagggaccagccaagcaacagaataagggagacctcaccaggggtaaggacacagaaatgggtcaaaggacttaaatagacatttctctaaaagaagatatatacacaaatggccaataagcatatgaaaagaagttcagcatccttaaacatgaggagtatgaaaaccaaaaccataatgagataccacttcacatccactagcatagctataataaaaaaaaataaatgacaacaaatgaagtagaaaaactggagcacttatacactgcagacagggatgtaaaatggtgcagccaatttggaaaacagtttggcaagtctgcttctacagagctacacaagagaactaaaaacatccacacaaaaatgtgtacaggactgttcatagcagaatttttttaaaatttgagatggggtcttgctatgttgcccaggttggtctcaaactcctgggctcaagtgatcctcctgcctcagcctcctgagtagacggattataggcaccttgcccagcttctatagcagcatttttttctaacacctaaaaaatggaaacaagccaaatgctcatccactggtaaatggataaacaaactgtagtctttctatacactggaatatttggctataaaaaagaatgaaatattgatacatgctacaacattgatgaacttcaaaaacatgctaagagaaagccagtcacagaaaaatacatagtattctataaaatgtctaggaaacgtaaatctatatagtcagaaagtagattagtggttgcctaggaccggggggaaagggataagggaacatggggagtgacagctaatgggactgctaataggacctacagtttctctttaggtgatgaaaacatgctaaaattacattatagcaatgattataccatgtgaaaacatatagaaatcactagactgtgtactttaaaaggtgaattgtatggtttatcttaataaagctgtttttaaaaaatatctcactgggggctgggcgtggtggctcacgcctgtaatcccagcactttgggaggctgaggtgggtggatcacgaggtcaggagattgagaccatcctggctaacatggtgaaaccccctctctactgaaaatacaaaaaaaattagctgggtgtggtggcaggcacctgtagtcccagctacttgggaggctgaggcaggagaatggcgtgaacctgggaggcagagcttgcagtaagctgagatcacgccactgcactccagcctgggggacagagcaagactccatctcaaaaaaaaaaaaaaaaaaaaaaaaaggaaaaaaaaatctcattgggaaagagacagaatctgggcatgacctcatactgggtaacccgaccagggattggtgaatctcagtgggatctgttaggcagactggaggtgtctgatccccaacctttgcctccacaaggctcctgggcaacagctattaggaaagctcatgaggctgctcagagagagacaggggaagtacacacagcagaacctcagcaccccagcacctacaacaggaaacccgagaaggaagcagtacccatgatctggctttgggatgaacagagctttctatggggaaaagacacaaggcataaggtagtcatcaccatgctgagacagggcattaccaagtgaggtcacaagctcaaggttttccagcatcacactgtggtacaggtgcctctgggctgcatcaaggagctcccactcctcttgggagaagtatacagccacatcttcaaaggttaccatgctcttcaatgtggggacagctgagccacagggccaagaagtatgctgacaaagaaacaaacaattggtcaaatggaaatatgcaggaccttgctgtgtgactcagaatcctgatacatctaccactaatatctctttttcttatgatcctctcagtccacccactactcacccatccacagcttatcttcttcctcagggcccccacctaacatgccctggaattaatggtgcccctctctcctagtagtcccactggtcactgtatccaggccaacccaacctagaggaacaataggcaggtgggcagatggatgcttcctcctccctcctgctggccaattttccttgtgtcttctggctcatacctcccaaacataagaaaatttgggcttccctttcttaagcctcttgtaccagggccatgggcccaatggttcacattctctcacctttacatgtcactcctcagaccatacagttcttatatttccaacccctccctgttcacactgtaggcattctccctagcatctcaccatgcacatggcatacctgacagatgcaaccgggatccattcctggtccaagccagctacagagctccaaaaaccccactgcaagaggcagtcatagcccctcaagtcaatgcctcccctgccagccctgttccttcaaccatcagctgcccagaaccataagcagatctcaaatatctcttccctctgatatctttgcctttgtatgtgttgtctcctccccagtcatagctgtccttgctcttcctaacactcaaatccaagatccactggcccccaccttggcttggggactcagcttaggctgaccctttctgatcttgccactccaccagcctgacaaaaaccccaggaccctatttaagaagagataacatgccctgaccacaagaaggatggccgcaacaatgtagtgagctgtagagaagcaaatcaacctaaaccaaagcccaactctcatcctacttttgccgctatgcttcactgttgtcctagacctactctctgctcaggaggctcagccactatcttgaacccaacccacaactgcatgcagtgtccacacacaagcatccatcccttggatgtttccagcctaaacccgacataatttcataatcacatgtttagtggtctacttggcacctcaatttggtagtgtctgggacatctcaaatacaacatggccaaaatccaactctttatcttccccctgaaatctactcctcacaccaacttccacatctgaaagatctaaggtcaatttttttttttttttttttgagacagagtctcgctctgtcacccaggttggagtgcagtggcgcgatcttggctcactgcaagctccgcctcccgggttcaagccattctcctgcctcagcctcccgagtagctgggactacaggcacccaccaccacgcctgactaattttttgtatttttagtagagatggggtttcaccgtgttagccaggatggtctcaatctcctgacctagtgatccacctgcctcggcctcccaaagtgctgggattacaggcgtgagccaccacgcccggcaatttttttttttttttaagacagagtctcgctctgtcactcaggctggagcgcagtggcacgatctcagctcaatgcaacctccatctcccagattcaaacagttcttctgcctcagtttcccaagttgctgggattacaggtgcacactaccatgtcctggctaatttttctgtatttttagtagaggtggggtttcgccacgttggccaggctggtcttgaactcctgacctcaagtgatctggccgccttggcctcccaaagtgctgggattacaagtgtgagccactgcactcagccttaggtcaatcttaacatttcactttctttcactgtcccacatcaggtaatccatggcccagtttgggcagattcagaagccaaccatctgtcctacctccacgggcacccctctgtccagctacccaaagcacacatctggaccacatctgtcagctcctcactggccttcctgctccaccatcaccatccctccagtctgctgcccactaggcatccatagggcgtctgttaagactggagtcagagcacctacttcctctactccaaaccttccatggctcccaccaccatcagaatagaggtccagctcctcaggctgccattccaggcctaactattggtttcccttccctgtttccaccagactaaatggagaccggcagtccccagaatgcttccatttcatcaccactaaacaaggtacacatgctggtcactgtccctgggacagccttccagatctcattccacaggattccagaaatgggaatccctcgatataaccccttgcctggattcaggatggtaagggtaagtgactcccagggcagggcccaggacccacgtgtgaggacaggacacgatcaagagtcccaggacaccaacatcccctctatctgggcttcaggatcctgagggccggaatcccagcgggtgagggcctggggcacactccacttacctgcgccgggcccatcagcaacgctggcaaccccattagaacctgtgggctgggcagggccat

SEQ ID NO: 247 - DNA, 10000 bp, Homo sapien
tatatgtcataaaatgggctttaatgttccctcttacaacatggtattactgcttacactggaactggcacacagctcccaaggttggtttactctgaggaatgaagctggtatcccccctggctgcagtgcagctggagcggtcccaggcactgagctcagtataaactttggagtctaaatacccacatctcctgtagttcaccaactttgcagttctggaaccggcagtgcagattctgtgtatgccaagtaaaccagacactgttctgcctctttgtactaactgctctccaaccaccccctactctgcctccagtattactctgctttgtgagatactaaggaatggtctgcctctgcagggcctaaatctcccatacttgcggtttgaatcctctgttctgttttgtatttgctttaaatatcttggaagtgtgacccacgctaacatgacttgccctgtccaggcaactcttggaattcacatctcccacgtttcttcctagctgatggctccctactacgcccaccacagtagggtgattccaaagaactgcatttaggagtgaagacaggagtctgtcttccttctatacccagtcagtccttgtctcgatcactttatctctttaacatgcacatctgcatgtacatagagctctggaaggatcatcttatctgaaggctatggaaacattttctgattcatggaattatccctttcattgagtgatgttcaaactgtagactggtctctgccttcccagatgtcttcccgttgcttggcttccaaccgctttctctctgtaaataagagcagtattaaccacagttgtctacttcatataaccaatgactttcccttagtccaaattacaaggcaaactttagtcatgagacaagtggatatcctggtctctcttacctgataacaagagttaattcctttaatttcctaagtgctttgtaagtgaaaatgatactactgtaagtcattacatttactactatataataaaaaatatctgaggctaatagaagtatatggaataagtcagaatctagtagggactcagattctagtcttgctaatacatatttaaattctacttttcaactatgtttagtgcttcaacacaattgcccattattctcagcttactgatctttacaaatatttcaataagtatcaaggatatgtattgatattcttctattttgttgcttaaatggaaatggtagcccctgggctttactcatatctcctctctaaaactttattgaaaaaatatttcagaggcaaaccacatttcaatattttcagagcacttccaggagccagaaatcttctggaatatacaattacaatatggaaaactaaaactatttctaaaaacaaaaaatatacaaatctggataattcatcttcaatttttaatatagaagcttggttctccataacactttcaccaaggtctgagaaaatatggaccatacaacagtctggtgacccaagcgctcctttaggtgccacaataccagttccaattgcatggctagtcatttatcttgacaccataaaatggggataagcctacatcatagatggtaagcctaaatgcttccttcttactgttccaaattgataatgcctgtataaggtttagcaagtcatgaaccagggagattacagaaatcgagatgaattcagaataaacacttgctattctgatatatctttcctcatcagcagaatcccttacaacattcctatactgtatttgactgtactttaagggcaaagaagttagttatgaagctgactggcacttggaaatgtgagaaaaagaaattcactgctatttgggcaccatcttgtggcattatctgaatatagcagcaaagttacaagaggcaaaaaacagtggtctgcaaattgcaaaatgaaggctggtagagaatgccctggaactgaggcaggccttgaactgcactggggttctctaggagacagcacaaaggataactggtttgtctaatggattccagaatttcttaggaaggcagcatggtcttgattcttacaaacatggagaagttaggaggagatctaaaggcaatggatgaaagcaatcaaaatctggttctacatcccaaggaaaaatgaagaaaccagaaaagtaaattattagaactccaatttttcaataaggtgtgaaacttaaatctttaagagtaatatgagaagagatccgagagcagtagaaaaatataacaggcccataacacacaattccaaaatcaaaacaattctgaaaacaaagttattgctttctttaaagcttggggccaaaattaatcgatggaggcaaatctaacttgaaaggatacgaagctatttatagtctttacatatcccatttagtgtgaacagtcacacactctgctgcagaaatattaatgtgtctgattttggcgttataagacagataccatattacctttctaaaatctggaaagttcagaattctgaacctttttttttggagatggagtctcgctctgtcacccagggtggagtgcagtggtgtgatcttggcttactgcaacctccgcctcccaggttcaagcaattctcatgcctcagtctcctgagtagctcttgagtaacaggcacatgccaccatgcctggctaatttttttgtatatgtagtagagacagagtttcgccatgctagccagaatggtcttgaactcctgagctcaggtaatctgcccacctcggcctcccaaagtgctgggatgacaggcgtgagccactgtgcccggcctgaaacatttcctaacactttctaataaaagtaaatagattctaatggtaagccatatgaaaaaactagtaagagtaggaagacaaattgagaagcacaaagaaatagtgaaaatgtgaggtgtaaatttagaaatacaagaacatgaatagaatagagaaatgtaggtcaggataggaaataataatttctttattttaaagatgaggaaacagaagctcagagagctgaaatgacttgcctaaggttacacagccagtgaaagaactgaatctgggacccagatccttaattcttcaccagcacactttctactatcctgacatctgaaaatatctacaagggaaaaaaatatgaaaaaaattgtataaacagaaagacaaagaaacatgtccctttattaaagagaaaggaaagcagataatagctgataaactgcatgaaacaaagctcctactaacttgacctccaacaattaaaagaataaagagaaagcccaacagtagacacaagggcaaggaattaagaaaaaatagaaaattcagcacaaaatgattgacctaaaacattcacattggctggccctgaaaactttcattctccaatataataaatcaatcaacagaaatgactatattaaatgagttgcctgcaatcacggtgcagtcaagactttacataagagaatgtaaagcgttgaagattgtaaaagggccagtttggtgtcatgttttaaaaaaagcagagagaggatgtaaattaaagactttcaaaatttattctagatctatgaaaaataatcacaaaatctactgtagtcacatacagaacaatagacaacatgctttgtgaagaacgcgtctggtcaaacgaatcttattcccttcttttagagtgacggacatagtagatcaaggagaagtaatctaaataacctcttaattttagcaaagttttagattttaagtttactaaatatttatatgatcataatatatggaaaaatacagtctgaatcccataagggggcatttaactctagagagtagaataattatcaatgtattaagtgttaacacaaggaaccatgtactatttattttagcaacagctggtgacctggtcagttagttagtcctagttaacattttcatctctgatctaggcaaaggtattaggtttattaaacagcaattgacaccaaaaaatgagtaaacgctacatcacagaaaaaaagtcacattaaaatgaaaaaaaaaaaaaaaatgtggttagaaatgaacttcagacatcaggggagaaaaaacgccaagaaaataccctaagacctagattatgaatcagcaatgccacactgccctttaaggcagaataatggaaagtctaaagaaggttttcagaaggtatgaactgtgattaaatttattactatcttatagagatggtttgaagttctttgtgatttaattaatcaaactaggtgagcgggctactgtttacttactttgcctttcaggcttgtgacccaaaagatggcctttcagaaccagccaattaatcacctaccttcaagaataaaatgaaaataaattaaaataaaattgtagcaggctttgaaaatgagaagatagcttattctgagaggtaacgatatctaagtccagttttaggtgggaatcaaatatctggatgagtggaacatgggaaaattttatatacattcctgagtttggtctttattttgttttttatttttttgagatggagtcttgctcagttgcccaggctggagtatggtggtgcaatctcggctcaccgcaacctccgcctctcaggttcaagcgattctcctgcctcagcctgctgagtagctgggactacaggtgcgcgccaccatgcccggctaatttttctatttttagtagagacagggtttcaccatgttggccaggctggactcaaacacctgacctcagatgatccgcccactttggcatcccaaaatgctgggattacaggagtgagccaccatgcctggccctgagtttggtctttaaaatgtggttttaggctgggcacagtggctcaggtctgtaactccagcactttaggaggccaaggcaggagatcacttgagtccaagagtttgagactagcctaggcaacacagagagaccccatcactactaaaaggaaaaaattagccagcatggtggcacatgcctgtagtcccagctactcaggaggctgaggtggaaggattccttatgcctgggacgttgaggctgcagagagctgtgatcgtgccactgcactccagcctgggtgacaaagtgagaccctgtctcaataaataaataaataatcaaagtagagtgaaaaatatagcagaaaagtacttaaaactcaaaatcacaaattcaaaattcttaattaggaaggtttcacattctgggttttataaagaaaaacatggaggacttagcattcagagtagagtcaagatttacaaagaaaaattagagtaaccaatgtcatccatgtatttggtcaatgaacatgtactgagtatctttttatgtaccaggcactgttgctagacagcagaactcttcaagcgggagaaagaaaggctgggagattattataccatattataacaggatgatatatagatttcaattcccatgctaattctgataaattggcaatggtcatgtcaaaactcaccaagaaagaatgtcatgactgatttaacaatatctgccacttgtaatggatggagagtagcagtatataatacgtatttgtcattacaagctcatattataatgaacattaaattcttaacagtcatatcaataatcatatcctgaatttgtaaagcacttttccaaacatttttacatatgttaacttattctgtgctcaaaaaattctccatgattaggtaggctgaggagtactttcgctttgctggaaaccagggggcacagagaagtataactgacttgcccatggccacgcagctagttaatggcaaaagctctattagagcccagatttcctcatttctaaacaatctgcccctaatctttagcgttaaagttgttagaacaaaatagtatgcagatattctctatttctactaaggaaaaaacaagaggacactggtttaaactatcatgcagatttaagttagacctaaggaagatttttctgacagtgaaaagctgctaaccattggtacagataacaaagaagcttgtcatattttgttcctggagactttaaaaaatgttttatgtaagtttttttttctgggagaaaatgtcaataactgcaaaagtcctttaagggggattacagtattacagaagaagcatgggttttaatcagcggtacctagattcagatgccttctctttcagtttaccagctgggtgaccttaggccagtttaacttctctgggtcagctctaaactcaagatggtatcactggtcacagagttatcataatgcaatatcatcataacctgtaagttatgatggagtttccttcctgtccttttaatcaacaaaaaccatttatggtttttaatcttaaaatcttcagaactgaagtgagaggaaaaacaactgcttaaaatacctaaaagaggaacatattttcttccctactcaaggcagattatcttcactagactgtaaggcttaaggagaggaacaaaatcttgccatctttctaattctcctaaacagggaacacagtgctctgcacagggcaggtgctcagtgaatgccaaatggagctaacagatgattacaggaattttaaaataaaaagagtaatgacaaaaatatgcactgaaatctgtgctggattcaccatataatgatatttctattattactaacaaaaacaacagcagctaacacttaccatataactcattataggcctatagaaacaggagcaagagagtacctatggttttttgaagatgactaagtatccttcatggattaacttgcttgagctctgtttaaggatgagaaaacaggcctccagaaagtaagtaagttacttacctaccctctcaaggtcacacagacagtaaatggcagacctaagatgtggacccaggaagtgagattccagagtctaatacctaaaacagtaaagtttccactgaaaaaaaatatttaaagcctgggctccatgcaggcaagcatataagtatctgcccaacacagaaagatgccagaaagaaatacatcaggaaatcttccagatgcatttcctcagatataaagaatggtagcacgctggagcataataaagagtcctcataatccatacagcctcagcaccaataggtaggagaaacttatcacagtgggtctctattcacaaataaaggccttctttagaaaagcaatagagtacccgcttagtcaacagaatcatttttaattgcatcactgaaatgtcctttgcatagccagacatttaaaacaaatacttcaagtggagctgcatgctgatgcacctagagaaagaaaagggaatactcaagatgatatccacgcaaaaccactgctgcaggatctgtagagatacaggtgatatacacccacagagaagcatgataacatggcaaagggagtcatatccccttttatagatatcactgttatcacacagaaatcattttcttcagagacaaccaattaacaaagggttaaggacactgtacattcatctttaatctagttctgttattgccatctataaaaacccaaggaatccggttatgtttctatagtctgtaggaggcctttgagtaaacaatgattggaaaacatggaaactgcctcattataatcattaaagtttcaaaaattagttgggttcaactctgaaactctagcacctgccatgacacactctgtcactggttatctggccagtgcagctgggagtccgcaagctgcctgctatcactaaagcagagaggacaggacgtattaatggccttgttagaccagcaataaacaaggagtttgaaacttcaattcgtttaatggaaaaatgaagttacttttcggtaagtggaattttcagaataaattgccttcacagattccaggaattgtgggctaaggcaatgagactgtctaaagcctgaaggttgataaaaagtacttaagtgccacaccagagtcccaagcctttacatacaattcaacagcctgtagaggagagagagattttaacttcagctccaaactataagaaagaaaaactctgcttgtggatcaggggaaatatttttctgagaactcttggatactggaaaataatcagaagacaggtaaatctagatgtactctaatggagccactcaggactgtcttaaaaagacaaaaatacctcctacagttgttatcatcaacgtcagttgctggcttttcctaaatttgtcttctacctcagatctaaaccatttgataacattagggcaatatcatggcaatcgtggcccagtaaaaccatagcaaatgttttctccctaggacactatctgttttcacaggaaaatttttctcatagaaaaactgtaggaaaagccatggatgagctgagaagaccaaacctatctcttggaaaacaacagtaggagcgtggattagaatgtcttggtgcgtgaaacaggcagacaatcctgaaacatcttctcctggacgtaaggcatgaaaatttctatacacttaggaggcttctaggaaacagaaacgacaaaaatggaatgggcttcattcatttttttttaaacacatgccttacagtgagttctgaagggcctagagaagaacaccaccctttcagctcacctctggcttcttgcagtttcttgagctctgcttctcgttcggttttgctctgcttacttcgaaccccaagggcactgatgactaaccttctggctagggctgctgaagtctcaggacgctcctttgctggctggaggaactctgaatcgaagaaaggaagggagtaggaaggagtcaagaagagagagcactctagcttcaagtgatttaactcagtaattaacatacaaaatagactaacaagggctgcatcagcagtaattaatacaagtctgatagatgatgatcagaggaaattaacatggcaaagcacaaacaaccctggcttcattatctgcattaacaaagtatcttacagtgactctatcaggcagctaaacacagaggtaaactaggtagggatgtcatcagaaactgattgctgcattgcctgcagttagttctcacacactccaagtggctgctcagatgccatatttccaacatggtcatttcccttttatttattttttcttaaaaacatatttcttttaacactaaaaataaaagtgatatgtctttagatgtctggatgctataaaacttctggaaagaacaataataccaccatcagcaagaaaaaaacccagagattatagactcaccagcataagctctagctttggccttggctgctcttgtggcctgtgacaagggacgaatcttcaccatggtgtgtttaatacccaacgcatcacgagctgcaaagaggaataaaaggaagcagaagacatgaagtagagtgatgcaaaggaaaaactagggatagctcttagtatttcctagatgttatgcttttttttcaaagcaagcaaaagagacagatctaaagatcaacgtggcagtaattattttagatcaggtatcagcaaactatggctccatgaccaaatccagccaaccacctgtttttatatttatttacaaagtaattttattattttactgaagcagagccatgcccatttggtttgtatattgtctatggctgctttcttgctccaacagcagagttaagtagtgacagagacctgatgctccacaaagcctaaaatattgtatttactgtttggtcctttatagaataattttgcagatccatattctaggtggttcagataggaactaacgtttcaatatctctattttctttgaatgcctctgcatcagatctatcatgaggccaatggtatatgtaagaaggcccaatcatatattcagagggta

SEQ ID NO: 248 - DNA, 4503 bp, Homo sapien
cctctcgtgccgcaccgtagggggcggtgtcggagttctgtctgggcctattcgggtccgagttcggaatttcggttcaaggcccagttcctcggattgttcctgcgcaacttcagtttcccttccaggcacgggcaatgtaaataatgatagcctccctcatctctggcggctgggtattatggctggggaaggggctcattcgattcgttgaagcttttcatggactccctgagctggcacctgggagatcgtcccatcccagggtcccgagtgtcaggtttggctagggtctgggggagaggtggtcctcccttctccctgcgggggcgcggtgaggagcgggcctgctcctccggggagttctgccgcattctcccaatctctttcctgagaagtggcggagttgggggcacttcgaggtcgccttggggcgaggtggtcgtgagggggtcccagatatgccagcagcggggggaggtcacctttgagaaagtgcgtggaggtgggtttcttcagaagcgcggagtctttctgggtgcgagcctgggggtagcgggtggtggctttgaggatggtctccaggggggccctctgtgtgtggggtctccgtctgggtaggggccaggaatatcagcggagggactcagggtcgtccctatgtgtgacagtggcgctgtgtgttggggagcttcgggaaagcactttttttgagtgatagggggcctggtctcccctggagggtgggcgggttatctgagggagtcctcggagggtcgcccccttgcgcgtcagagttgctgcgtggggtctcagagatagcgcctgggctggggaaatcattgtggggtctccgtggtaaggttagcggggtggggacggcctgcgtcttcggcaggtcgtcgcagtctggcaccatcgttgaatggggacgagtttgggaagggtattttaggggggaataacttttgagttcccagcgtgcgggggaagggcgggacgggagggtgtcccaaggcctgagaagatcagtgtggggcaggggtcaggaataacctgggagggggccttgtatgggggaaataattgggaaggggagagatgggatgaagggggcctcagcgggtcgtctcctgtgtatgcagggtcgttctgcagcgtctctgggagatggcgtccctgggagccctcaggtcgcccctacccgctgcggggtgctttcctggcgtcacgccttcctggcccctggagggaaggaagtgaaactctcctcttcccccacccggctggaatgcgagtcaggaagcctggggctccagcctgctccggctgcccgggtcggggatggggaggggcgtggccggagcgcaaagccccgcccctccgcgccccccccccggaagccccgccgccggccgctaaggcgatcacgggccctgtcctaatatgggcaaccggaagcggcccgcgcgactgccctacgtcactccgtccaaatttagttgtggaagtcagcgggcgctggtggcgggaaggcgccgcgagccagtgcgggcggaaagggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaacccgggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcactcgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagccggtgc

SEQ ID NO: 249 - DNA, 10000 bp, Homo sapien
acagagaacaaatgtatccctgttgcatctgaactggaaaaccatttttagagggaagtgtgacaatgctgctgtggcctgggttccaagaaagaatgcatgtggcacccagtctattgccctgtgcacccactctttattgccgctgggccaggcaccaggtcatgcctgggccaaggaggggagatcctgacaaggggatgccaccttgtggccagcaagtggggcccagctgagctctgaggcctgtggccggctggtcaaccttgaggtgcggtccagggcacagagccctcggggagagctggggcacaggccgggtggtgcacacagcccccatgcacagctctagccttgtgagtcactggctgtgggctcctggcagaactcatccatgaactcgaggaagtggccgaacttgggctggctctcactcagcgctgggcaggccatggggagcggggtagtcccgaacactgtgcgcagagagccactcaccagctgccggtaacgtgcctggaactccttcaacagcctcttggcctccaggtactgcttgtggttcaccagccgccgttctgtccactggtgcaggacagcacctgcaggaaaagaagccaggagaggcaccaagctcatcctggttctcacctagccagaagcaagaggattgggtccagagacccttggaaaatgggatggtgtggcaggaggatgctaaggggctaaaaatggcctttccagcttgggaagtcactgacttcctactgcccctatgcattgactctatcttaagccctggttcaggaccttaacatgctgtgtgattttaggcaactccctgcctcacgctggctctccttttgtccatctacatgtagagactgatgtaggcagttgctctctaagggcctttcctgcactgacacaagccctttctttgcctttagccagcaggcgtgaactggatctgggatcctggcagctgtggcagagccgtacctagtggagcctctgtaatgttccggggatcccgcaagcgaatgaagatgtcatccagaagttgggctctagtcttctttgggggtggaatcgggattctctgggcctggcagaaggtcatggaggagggtgttatcccaggtttatgcacagacttccctggcctaacttcatacagtcacagcaacaggctggggggcatctgggggtgctgggaaagcatggccctcagagggtcccaaggtgacagccacatctgtaattgtgggcggtactcaggggccatttacacattcagtgagctggatgtttacccgtttctctttgtgaacatagggtttctgaagagtgtccagcttgggcttggaggagtggcacaggagtgggtgcttcagcatttgttgcagggcttgtgcattcttctggattcctagggcaagaaggcaagactgagtcaaggcacttccccctcctcctcccagatgcctcccctgattgcttcattcctcagtctcacagcagctctaggtaaaaggatttgagagtccccaaaagaaaacactgcccccaggtttcttccggatctgttccagtgcctgaagttccatcattcttcagtgagtatttgtcccatattataatggaaaaatagcacagattgtaatgggtaaatagtattggagtgggggaaaaggctggctccaatgtgaccccattaacctcagggggttatatcgcaggggctaacacccagaacagcccagctgaatgccagttgctttggaagtactgattaacacagagatgaagctgcctcctttgcctccaaccagataggaacgattttggacgttcagtttgggaacttaacctgggctgggaaaagctcaagaatctggccattctgggtgttcattcatcacacttttcctgaggagagactttatcatccagagcagctaggctgagaccaactagaatctctgaataaactgtggctccccataagccagtgaaggcctaggccaggacaggggtcccaatatgtggggcttcaaacaaaggacaccctaaaaggagccctttgacaggtatttagacagaggacagcaccctagttgggaaaagacagcttggtgccagccttggcttgaccctgacttgctctgagctgtggagatggcctcttgccctagagcaaggatatgccctcacataccctttggctcaatgaaggctggatcaggcttggctgtcagcagttcttcatagccgtggtacttgctgggaaggaaggcagttgggagtttcctccgagtccctttcacctctctgggtgccgttggtggtttcttttggtctttctcctttaactctaaatcatccttatggatgacggaggaaggcagttcactcacctgtgcccaggaagaaaacgcattcatttgtcactcattcattcattcattccatgaacattcggagtatcatctctgtgctggtctctgctgggccctgttaagggcaagggtaagaccaagactgggatggaagaaagcagatataaaaatagacaattgataaatgctttaacagagggaatacagtggttttgggtgatcccagaggaagccccaacctagccaagaagctcccttggaggaatgccttagcctgagctaagtcttgaagagccaggagagccatccctacggagcaatggggagaggtgtggactgcaagtgatgagaaagaatgattgtttcagacaaggaacagcacgagcaaaggcgcagaggtaagaaacatcaaggtgcattttcggggaactaaagattggtacagttaagtacaaagtgaagagataggcaactgcagtggtaagcaggacccggatcggtaaggaccattatatgccaagctgagggtgcgttttattttgtattttctttatgctcactctgatggcaaaccatggaggattttagcctatcctaatggctttataagaaatctgtatgtcatgtagggatgtatttatttattaaaattactcaccaggtggggtggcacatgcctgtagtcctagctactcaggaggctgagatgggaggactgcttgagctcgggagctctaggctgtagtgcattatgctcctcgagtgtccacagtatgtttggcatcaatatggtgacctcccaggagtgggagaccaccaggttgcctaaggagagatgaacttgcctaggtagaaaatggagcaggtcaaaactcgcatcctgatcagtagtgggatggtgcctgtgaacagccattgcactacagcctgggcaacatagtgagaccccaccatgtatatacgtgtgtgtatttgtgaatatatattatatatacacacgtatgtgtgtacatatatatgacctataacaagcaaaaaagctgaattagcaatttttaaacttcccacaaagaaaagccaaggaccagatggtttcactggtgaatgctaccaaacatttaaaaaagaattaacaccaatacttcacaaactcttccaaaaattaaaagaggcttattctctgaggttagtattaccctgaaatccaaactagagaaagacatcacaagaaaggaaaaatacaaagcagtatcacttatgaatataaatgcaaacattctcaaaaaatattagcaaactgaattcaacaagtaaaagggattatatactatgaccaagtgagatttatcctaggaatgaaaggttggtttaacatctggaaatcaattaatataatatatcaaaaccatatgatcatctcagtagacataggaaaagcccactctgtcatgattaaaaaacactcaaactaggaatagaaagtaacttcctcaaccagataaagatcatctatggaaaaccctcacctaatatcataattaatggtgaaagactgaatgctttccccttaagaacaggcacaagacaaggaagtctgctctcaccacttctgttcatcattgtattaaaggttatagccaggacaattaggccagaaaaaaaaagatttttttttttttttctgaaaacatggtgactcataattgattgtattgctttggccgctaggagctcagaactgcattttgtcaaaacacctttattataatagcagcagtgcatgatgtgcatgtttgagtgacagaattacccttgtactatttcctttcctgtccgtattttcttttcatctaactctctcaaattgtttcttttaaaatgcttatttatattctgcattgctccaaaaaggttctgagatatttctttaagatacttttatactgtataaatttatatgtcactataagtcatctgtggaaaaagaaatagatggagagttagacctccatgaatggatagatgtacatcctggaaagatctggcagtgagcagactggaggggcaagactagaggcagggagatcagggagagggatggtacagtaataaagttcaagggggccctgccaactcttctagccttatattaccctttgccacatgccacccttctgctgcactgacactaaacatttgtggtttctgcatgtaccattttaatttccttcctctatcctgtttcatgctgtttcctctgtccagaatgcccttgctgctatatcttcacctttttaattcctactcagcctgtaaatctcagctcagttgagcctcttccaggaagccctcctgggctggggcagaggcatctctccttcctccagactcccagcctctgggattccctcagtctcagcactgattgcataagctgttcctgtctatgttccccattatactgagagcaccttaagggcacgacctgcatctgatctatgttcccaggatccagaggcagcatcaaaagtgaggagacctgaagcagagaggtacaggcagcagcaaacccctctgaaaaactagttggaatcacaccccagtcagaccccagatcttgactgtgccacagaaccatgacttatccccatgggtgtccctatcaggtatccctatcagtgtcctcagaccagagatctcccagaagaggcttgcaagctccaccaagggtgctgacttcttgtttccagacctgccatgtgcttgttgctcccagctgtccacagcaatcgagcctaagggctgcacaggaacctgtgggagctagcaacaagtgggcaggggcagctggatacaggtacctgggtcaggaagatggactctgtgctcttggagtcctcatctgatgggcgctctgggctgaggcggacagttgtgtcactcaggtgggacagggtctcttcactatgcacagtggagttggagcagatgggaggcagtggcacgaaggtccggcaagacggggaatggccttccaggttctcagtgggcatctctgactccacagaagtgcttttggtagtgggcagatcttcagccagctctgcctctggctctagcatatcctttgagggagacttggttgtcgtcatgcgcgggtgatggagcaccagaggctgcttcggcacctttgggatttcgcttttcacctgtcatggagaagggccagaatgaatttgcttcctaattaggattctctcctcctgggcctcactagcctaaggccacttgtatagcagccggagtgctgggtacggactgaggcgggggtggaaagggaaatcatacttgttgggcatctatgatgtgccccatgcatgatgtaagttgttttatttctaccttgaaactacccaatgaataattatccccaattttatagatgaggaaacaggggcttagagaggtaaaatgacctgtccaagtcccagagtgatttggcggtagtgcctggacgatgtaattccagtcctgggctccaggcttcatgctgcatccctgaccatacgtactctggccctcagtagtctcattcttcagatgagggttgaacatggtgcctatggctttccccagggactccgaggagagggtgttggggaatggtcctgtattttctggaagatgacagcaccaggcccctttcaggatgctgttccctataccttatataaagatcctaaagatagatctctctgaaagattcaggaccaagaaaataattcccttaattagtaaaagcctgtgaccattctccctctcctcctcagcctcagctgccaggaggtgtccatgtgccctcagctgggtttagtcctttctttctccccctttacatagtggattgttttcactctttgtcagaggtatttggttcacttatatctgtacttttactgagagatgtaagttgtgtagtggaaagattgcaagcactgtagttagaaaaatgtgggctagaatacaggtctatcctttgagcacctatttcctccttgtgcctgtctcacagagttccacccaatgaaatggtgtgtgcaaatgtacctaatggactaaggagggcgaaggatgacttttataaaatatgttactttaaaaaaatgtatttccttttggaaaatatgtggaacctcagtgtttagactctgagggacccagagtctttgtctgaatccatgccacaaggcacagggcacggacacagcaccgcacctcagcatctaaaacaccaagcgccatcacttggcagctggcgggaagggacagttccccttccctctcatggctctgtgagagagatgtgctagaggaaatgctctttctctatcccaccgctactttccccgccccctcccaagggaggaatgggtaacctaactggccagaggttgagtcactgggccctgcttcagtcgtgggctggattactgctcatcaatgagaccaggctattttatcttccatttgtgtcctcacatcaaagggctcacacagcttcttggttacaggcctgctctggcaggttctccattttcctcctgtctgtccatgcctaggtgtgaggggagggactgcagcctttgtccatgtaaccccaggggtctaatctgcatttctagccccatctctgtatgcacaatgaggacatgcaggcatccccagtctgactcaggactaagtcacgttcttcagtccagaatagagggtgtttgcctacattaacaaagcattgatttgtttctcatttggccactggcatctgtgtttatttaactcatttagctcaaaggttagtcagaacctttgatgggaggaggtgtgaggggtcccctaggacccacactaacttttaacaagtcagttcacctctctgagtctgttgcttcatctactgtgaggattatgggatagcatacacgtaagagctctgcagagtcctgggcatggggctctgtaaaggagagaggattctgcccctccctggctggctgatgggaaatgatggggcagatccttaagaggaggtaacagacaaggaggaagatgatggaaaccttggaatttctatttctgacttcaaatgcttgtccagtcctctgaggacgtcagacaagagcctggctggacagaggcgggctgcagagggggtggcaaggaaacatctgtatttaacttttgggatcagcaatgctcagcccaccttttggctgtagaaagactaaagttcaggagggaggagcatttcacagaaatttttgaaattcttcagatgaaagagggatttcacttactttatggcaaaggaagcagacttctctcaacataaggaaacacttccttaagattcaggcaggagatgtattctggtcctgccttagctattcttttttttgttttgttttgtttttgtagagacaaggtctcacccaggctggtctcaaactcctgccctcaagcgatcctctcgccttggcctccaaagtgctgggattagaggcgtgagccaccacgcctggcccatagccattctcaattactgtaggtgactataactttcaatggtaagagttttaggagtttaaaatatattttcatatctgttgtttcatccagtgctcttcccaaagcaaggaaaggagaaggcaatgctgaacctaatggagagattccaggcactgtggagtgagcagctctacagccaggttggtttgcatacattataataggctgcactcttcctgggggtgggagtcctgccttggaagccctaccttccatgattccttccgagacatcaaaacatgatgcttaggctttactatcttccttcgaattaagtggattcccagtcgctcctggaggaagctcttcagcagtggagggacccctggtgccatgatgggaaaataagattactattagctaaaatttatactggggcttactatgtgccaggcactattcaaattgctttacatgtattactgaaacttattctcaaccctaggaggtaggtcgagaattcctacctcctaggagaattcctacctcctaccattattcccattcaataggcaaggaaactgaggcacagagaggctaaggaatttgtccaagataataaagatagtgtggagtgatgatcagaacttcactggtgtcactccagggcccaggactctaaaatgcctccaactcctgtatcttacacagtggctccactgctgaccactccattcagtgtgctctgggaagagaggctcctgcagttggggctgcacccctctgcaactgggaattgggaaatgaggtcatgacagaactgttccacaaagcagggtgtggttcaaaagagctcatacaggatttaaagaattccatattccattcccaactcagactctttcttgctgtgtgaccttgggcagatcatgaacctccctgagcctcagtttctaccactgtccgtggggacaataatgcctgctcacagggttactgtcaggaagcgctggtacagagctatttcctccattcctcaatgtaccatgaaccttgtccaccccgacacagagtagatcccagggcttggcattgatgaggtggggatgagggtgccacactgctccttgggcactgggttgagagggggcaggtttgcgggcactatacctcgtgtatgggccaccagagggttgttatgaaagacgaactcgcagagagatgggaagagagctactggtaggacagcatcctcttttgcgatctgtaatgaatgcaggagagactctcaggttgacaccacccctcacctctacccaggtatgtctaggcccctcactgcagggctacatgcttgctaggattgggggtggtattgggtaagacatgctgctgtggatgggactcactgctgggtgatgccttgaccctgtaataatacctactcatgcacagagtaccttgcccctcctgtctgaaattccaccatcactgttgcgtgtttaagagctaagagtttttcctcttttttccatgctggatatgtagcctacatcaaatactagggaagctggtggcaaaataataagaacaaacacatttttcgtacgaacaaactctttatctcataaagattctggaaggttggcagggcattgactttaacttcaggatacaatttgacacttcatcttcctcagcacaaacctctacacacttctgatggctctttcactgaggccagtcctgggcacttatttggggatggacagggggaaaggaggacccacacatctaagggataagtagagccagtgttaagagagacctcatggctgtctgggacacagagaatgccctgtgaagccagcctgcaatcggtggcttattggccaagccagcctctgaagggcaaaaaatatacaagctttgttgagcagactgcctggaaaagctggaccatcttggcgagagtatttatttgcaatggaagagtatcagggacatcaggatcgaaggggtcaggagtcagg

SEQ ID NO: 250 - DNA, 10000 bp, Homo sapien
tgtatcttaggtgctgagagtatctgattagggcatatcagactaaaaaaagtcctctacaaacactagaatttactaatctattttctacttaaaatgcatagataatttgacatcaagcacatgtacagtttatggaaacaattttattggtaacagaaccctactaactcatcagagccccactattttctcccgtgtactttccttctcctggcagcctgtcccccttccctgggaccccctcccaactcattcccgtgaactttctgacttgctgcctctctcccttctgggaaaaagtgtcagctgctgcactaataatccagcacatgctacgactgtccctgagacagctgtctactgcccctaggcacttgggcaggggatctccttggagccagaaagttaataactggtcttgaagatacaaacaatgtcatggtctatgactttgtgacacgatgcaaaggaaagcgtttgggctttgagtcaggcagacccagattcatacctcagctcttcttaatatgtgtgtgactttgggcaaagtactgcatgtttctagccctcagcttcctcatctgtgaaatggaaatcacaatacagagaatattgggaataacaaatgagaataaatatatttagccctctgtagatgctcagtgaccgggcttcctctcccactatctctttgtctttccagagttgaaagacccataacaaggaatcaaaggagagtgaaacgatgactaaaggtttagaggataagatctaagaatggatgaaggaggccgggcgcagtggctcacgcctgtaatcccagcacttaggcgggcggatcacgaggtcaggagattgagaccatcctggctaacacggtgaaatcccgtctctactaaaaacacaaaaaaattagccgggcgtgatggcgggcgcctgtagtcccagctattcgggaggctgaggcaggagaatggcgtcaacccgggaggcggagcttgcagcgagccgagattgcaccactgcactccagcctgggcgacagagcaagattccatctcaaaaaaaaaaaaaaaaaaaaggatcaaggaatggtaaacgtttattttattttattttattttattttattttgagatagagtctctctctgttgcctaggctggagtgcaatggcacaatctcagctcactgcaacctctgcctccccggttgaagcgattctcctgcctcagcctcctgagtagctgggactacaggcgggcaccaccacacccagctaatttttgtatttttagtagagacggggtttcaccatattggccaggatggtctcgatctcttgaccttgtgatctgcccgcctaggcctcacaaagtgctgggattacaggcatgagccaacgcgtccggcagaatggtaaatgtttaatatggaaaagggaacatttagtctggacagagaggacaataaataattatggctaccatttgtcaccacctttcctggcatttacttatttatttatttattgagatggagtttcgctcttgttgcccaggctggagtgcaatggcacaatctcggctcaccgcaacctccgcctcctgggttcaagcgattctcccgcctcaggctccccaggtagctgggattacaggcatgcaccaccacgcctggctaatttttgtatttttagtagagacggggtttctccatgttggtcaggctggtctcaaactcctgacctcaggtgatcctcctgcctcggcctcccaaagtgctgggattacaggtttgagccactgcgcctggcctttcctggcatttaaaatagctatgtccagtcttcagaacagccctgtggcgaggtatgatcatgaaacccacgttataaagtgaagaggaaacagattttataacttgcccaagatcatccagctaaatggagaagtggagattcaaagtcgggtctgactctttgtactagcttaagaacagactctcagctggatgtggtggctcatacctgtaatctcaacacttaaggaggccgaggcagatggatcacttgagcccaggagttttagaccacacaaacacacaaaaaattagccaggtgtggtggtgcatgcctgcagtcccagctactcaggaggctaaggagggaggattgattgagccctggtgattgaggctgcagttagccatgatcacaccaagagagggaagaaggaaggtggctgtcagtcactggtatcagagacaagcagaggacagagaagacaaatgcaaaatctttctttggctgggacttgtcagaaagggaatctccagtgttggtgatggtgtcaccaacagcctcatgtgccttatgtgtgggcatctctgaaggcagaaagaactccattttccctggaggaaaatggaccagtgagcatgaggctgaggtctgactcctgggggccacacaggcaggcctgagcaccttgcccctcctcactgaagggggcttaatgtctggggcacagttgactccatccctctcttttttcctgtatgtggttttttgtttttttttttttcaagacaaggtctcattctgtcacacagactggagtgcagtggcacaatctcagctcactgcaaactctgcctcccaggttcaagtgattctcccatctcagcctcccgagtagctgggactacaggcacgcacgtacaggctggtcttgaactcctgacctaaagtgatctgcctgcctcgtttttcctgtatgttctaatgttatttcagggatcccctttgcctcactctggccattccaaaacatatatatgtttcatttatataaatccaaatgaaaatattaaaattgcaagtgagatatttttggccttaatctttgaatttcaatgttttcttatctgtagagctggtgtgctaactcctgtaattctgggcaatgcccatgtggttcttggctgcttcaagccatctcaggtctgattttcacacaagctcagcagcactgggctagaagggtaccgccctcccactctgctgccactttgaatagaagtccaagctttcgctttcttgccctgactttgattcttcacattgctgaggagcagtgattgaagcttaatctcattgtctacagtccgtctcctctatggagctgcactattctttcccatctcaattatttctgatgtaaccaaaacactctctctccccactgccttttttcttttgtaaagacttgcaaagggtcagttccagaggctcgagccctgtgttctgactttcacagacagaggcctgccactcttacatttacaggtcatcattctgagcaatacactttttttgaagagtagtcctaaaagctcactaaaaagttgcatttgtatttaacttaaatagagaaccttatgtgtagtccatgtttctggactctatacctgattttgaatcactggacttaaattattggacttacaacactgatacatcttgtaaatgaacctaagcaaagaataccagccctacatcccactcccctcaagataactgggaaagacacaaagccatgctgaggaggagccatggtttgatattgtccagtgagtgtctcttggcctcagaatgctgccacttcctgcagttccagcccttggctgtggtccattctgagtaagtgaattcctctgttaaaacttgcacacaataaggagatggcgtcaccaacagccagagaagtcaagggtcctgatccatccagagacaaggtgaaaaggcaggctgggggggaaagggggaccagcagattaggccaagagtgtagcatcatgaaatgtgatgtcttcatgagaaatgcaaggaaataaagcatttgctgtacatatctaacccgtatgagagagaccccacttcttcagaggaaagcataccagggaggtcagaacttgggccaactccatgacttcaatggtagagaatggcacacgggccaaacaggatgcataccatcaccaagaagtgtcggggtctcaccggctaaagacatgttacaaaggtgccctcagtcacctgcccagagaataaagcagggcccaggcagggaaaaacacacaaggatactgatctttagctgctggcttcctggggtcttgatgccttggagatggaggataatgggagagcccgaaaggcagtctttgggggtttcagctgacccatctccctccatctgcatcttagaggccactcttctaaaaactacaggcgcatacctggtgggcagggaatctgtgccacttggtcaggtcaacatttccagatctcgttctccctggtcagatttatgatcattaagtctaaaacatctgctctttttcctcaagcaacagttacacctgagtggctggagaagccactccaggtaacagtacagcaggctgtccttactatggaagtttggcttgtggccacagctgtttgcagaatgcccacaagacatggtcctgcctctattctctgagggaactaccctgtctcccttgagaggagctgagttctagaagactgttgtaggacagatttggtttaaagttctttaaggcaatgctgtttctgtctgtggcagaaccctgtgtccaggacagaatagatggaggcagtggggtgctggtaaaccagctttctggaagagaaaacaccaccaccaccgattcatagcacttgttaattttcatcatgtaaatacctccatcatgatcagatttcaggctaccaaaggtttaaaaaccagttcacaaaaaatcctgaatatttaacaatcggccagcaggggctggctccatccagcagatccaggactctggggagctgggttgcataagacatcttttttctctgatgctttgaaatgttatgagcttactgtgttcttaaacttcagctacagaatcaaaacagggcagagactttctgaaagtatccttactcccccttaccctcaccaagagctggggctttcattttagtccttgaaagaagacttgaaaagtcacaattcttgttctcttttccaaatattttgagtgtcacaagttagaatctgatgaagaacttcaggtagaaagaatgtaagagccaaatctacgtgagttctcaggaatgagtctatacaacatggtaccaggggatacaggggatagcatcttgacatcacctcttaagcatgagactggacagtggcagaagatgggtggctttgtaatgctgagcaatgggaagaaggagttttaaagaaggttttaggacttcatgtatcttttgaggagaactaacagcaggctgcttacctccagtatcttggttccaaatcttcaccttgcaatcatgtgatgaggtagcaattaaaggcatcaaggccaatgctcttggtagaaagacgcaggatgcgacagtctggaaatgccccttatactcacatattctgtttcgagtctgtcttaggtcccacaactgcaaagtaatgacatggaccagctcatagtcacttgtctagcttcatccatgaatatctatctccccctacccccatgatgcacctattccctccacttacctgctcacgtagctaccccttatcttcatccatccacagacccaacaacccatccatccacagacccaatgacccatccatccagtgattattttaagcctcaactatgtctcaaacaaccctggttaagaatgtgtcatatgagtttttgcctttttagtggttagggaagtaaaagctcccagtcctacagcatgatggtgttccatcatggggaacccatggggagccccaaacaacagtatggggttgtttgctttcatggcaactcaagagctgccttatttcaacctcttggcatctgtgggccctgtggggaccccgtagttagaagtaccccatagatataagtacatctaggtgcagacattctgatttaatgcctagatgctgaaccttgatgtgtgaagactagcgtctacaagagggaagtgccagtcagtgctgccagtcccactctcattgatacagatcagatcacagctggagaataatgttcagggaggagagcaaattgaattatgtccaaaaagataatgaagttattggacagcatgttatccagggaatagctgtaggagctggaaatgtttcacttagaaaagagatgctacattcaaaggctgcaacaccccaatctaccatttactagggatgtggtcttgtgcaagagatgtcaacttgccatgcctctatttccttgtctgtgaaatgggaattataatagtacctaactcatggggttgtttttaaggattaaatgagatattacatgtaatgtgctcatcccagtgcccagcacacaagaaatgttcaataaaataggaggcataattgttctgtttgaatactagataacccttttaatggatattctacaattatgaatctaaggtgctttggaggagcctaggcaatctattccaaaattaaatgtaaggaaggtacatgagtaagggatggagtaggccctggaccaacactagagctccaaatttcctaaaaagcttgagcttcttttactgtggccacgcctataatgggaataaatctggttcttcaaacagtccctcccctctctaagctctgctgggagtagagacatcagcaggctggttctgtgtttagctcctccccatcttgactctcatcccattcctctttcctactaccaattcagagagccctaagttgatgaatgtttcttttattttctttctttatttttttgagatggggtctcccttgttgcccaggctggcctcaaactcctaggctcagttgatcctcccacctcagcctctgaatagcttggactacaggcacatgccaccatgcccagctaactttttatttttttatagagacagggtcttgctctgttgcccaagctagtctcaaactcctgggctcaattaatcctcccgccttggcctcccctatgaatgtttcttaaatgaagcaactggaatgcaaaggatcactcacagtatgcttttgaaagaggcctgagccattagcaaagcccgcctgtgtagcacagctacaggcatgaggccagagtaagtgatctgttcatcagcaaccagatacctggacctcacacagtctcctaccgtggcttcacagccttctcctccaaagccattgctgcaggagatacacttgtgtccatccacactgacttcacagtaggtctgaatgtgctgctttgcaggaaacatatgagctacctgcagcccccgactgtcccataatctgaaagagattagggcaggaaattagcttgtagtaaatgtggctgaaatacacccgtattgtcccactaccaaaaaagtcttggctctttgctgcataggccagtcagattggaatggcatgatttacctaaaaacggcagcatgaaccagatcaatctctgagactctaaagttggcaggaagtaaccaaattgaatgacatctgagttctttctattttgagatcagttaatagaaattgagaccaagcatcttaattgtacaagttaatttgttaatttggtcctttgagacactgctttccgtggacaaaaggatatttctgtgcctgtgacttaaatttttaaaaagatacttattatgatatgggaaatcagtcatcattcagaattagttacaaaagatttacatacaggtcatggccagccttggctatggggtccactggggagtgttttgttttgctttttatttcatttttacctctttaccccattcctaccattttctaaggagaatctcttctgagatccaaagtttctagttatcctctccggtctaagaactattggctttactgactcccctgatgctgatttcaaccctgcttccccagggagggcttcagctgaaggctgggtgactgagaacaccaggagccatgcaggggtagcaaggagagccaggcagcccaacagggtgggacaagcaagtgactgattctggggttaatctgaacaccttcacacagcaggagctggctgaatcagatgctttggaaccatccaaaacaggggcttttacttggcctgatctcatgacacacaacctctaccttaatgatccatggggccaaagcagagaggccccagcaccagtgaagggcagaggaacagaaggctctgggaagggcagagcaatgtggagaatcagagtgggaatggagccatgtatgcatgggagccacaaacctcacaagaaacactttcacagctgctcagtaagcccacctgagggttttatcttcagaggtctgtagtatgtatggttctctggggacccagcacaggtgagtgacctagaaaaagcaaaatgttcagaacttctccacaccaagtcattcctctgctgtaattcctgtcaaatgtgctaactagcatcactgtgcctcttctcaaggattctgaactagcaaattcatttacaggcatcttaggttttgcagatacctatcagtcatgctctacctgcatctcctaggttatcagcagcaagataacagctgggccagttgtgagcaccaaaatacatgcaggcaccctaagagtgcctgaaaccccagctgtgtggcagatagaacagctcctgttgtaaggtgggttcactgaaactctagccccaacacctcatggggatcaggaagagcattcatgtttctctttatccctgcaggtccctgctggataggcataaaatagtttccaaaataacccgaaataacaggattttcttttcttccagtaacctccaccaatatagagggcatggggcaagcatatctgaccattggcagtcatcttcaaaattagaaaagatgactgggactgaaatttgacaaccactaaaagaacatctagtatgggtcagacacaatgtcaggtatttcacatctagtatctgaattcatcctctgaagaaccttagcaggtgatagaattctccccattttataaatgaagacacagacactctaagagcttaagtaacttccttgagataacataactggtaagtaatagatccatgattttaacctgagtataactgactccaaaggctctccaatttataccagtctgctactagaaaacaactggtccttcaaaagcaatgcaaattctacataaagcaaaaggtaatgcttatttctccacatgatgttacacatatgaacatacaataagcataagctgtgaggtcctggaagacaggaactatgttcttggtcactaaccctgttcctagcacagtgtctggcccacagaagaaacagaataatgaaagaaataatgaagacaccattttaaattccaatataagtgagtaaaatcattgtctggagcagaagactcaagggaacatctaatctaataaccctgagaggccagggtctcacagcaggttaggggacagcaattgggacccaggctctaatttctgctcatgggcctcctgatttatctcccgagcctttccttcaccccatgctcctttctgctgccctgttctgtaccaagtttgagttcataccacgttcctggagacagatgctctttccacactctgtcctgtcaccacatcccacagaagcagggtgttgtcccgagagccagtgcacagctgtgatgagtctttggaaacaatggtgagaagacagcctgtgagtggggacctgaacggggcttttcagaaagcacaaaggcattgggaagaggtccgctttgttttacctggactcacagccaatccggtgaccaccatggcatggccacacaattgctgccttggttgtgaggaaccgtgcaagtcccacat

SEQ ID NO: 251 - DNA, 10000 bp, Homo sapien
cggatggatagaagatagacagattagacagagagagagagagaaaggagagagagagagagagagaaaagaggggaggggaggggaggggaggggaggggaggggaggggaggagaggagaggagaggagaggagaggagaggagaggagaggagaggagaggagaggagagagaaattaggcagaggagaggagagagaaattaggcagatgccttgggcagtgaagtccctggggatggtctactgttcccgcagcctgagcgcctttttcagacgtttttatctgtccactgctgcccctgcatggccacagcctgaactgcagcaccgaacgcagacccagtttcccttttggagaagaaattaatgctccttccagccccccacttgccactaggcctgtgcagggcgtggacagattctacagtggatccagccagagactgccccagagaaaattccaggggtgggatgagtgaggtatgctgggactggaatgtttgtaggataacatgatgagcagccggattcccaggaaattgcaaaccgtgtctgctctggtgagattctcagaggaggggatctataggcagttctgagtaggcactgggtaaaagcctggaaagaggaccctggcttggatggggctctgcctcactcgccatgagctccttggcgctatcagtcagcacagttcagctgcatgggtgtgaaggtgtcctggtgactggctacccccatgcctgcctcagtgcacgggaggtggaattatggatttggtggggctcgcacaggctaagggactgattttcagtctggagaatgggagggcaggatgagctgtggagggtcaggctggtggtttggagggtggcatgatgtaaatgtagctgttcactgttgtagtttgctgccaccagttcagtctggctaggttccaggtgggtcaataatctcaaatggggctgggctcagtggctcacacctgtaatcccagcacttcgggaggccgaggcgggtggatcacttgaggccaggagttcgagactagcctgcctaacatggtgaaacctcgtctataccaaaatataaaaaattagccaggtgtggtggcgggcgcctgtaagcccagctactcgggagactgaggcaggagaatgcttgaacccagggggtggaggttgcagtgagccaagatcgtgccactgcactccagcctgggcgacagagcgagattccaccaaaacaaacaaacaaacaaaatcccaaatcgggagaggtgaggtggggtctgtcatgccaaggagttggtttctttcttttttttttttttttttgagatggagtctcagtctgtcacccaggctggagtgcagtggcgctatctcggctcactgcaagctccgcctcccgggttcacgccattctcctgcctcagcctcccaagtagctgggactacaggtgcccgccaccacgcccggctaattttttgtatttttagtagagacgggatttcaccgtgttagccaggttgctctcgatctcctgacctcttgatccgcccgcctcggcctcccaaagtgctgggattacaggcgtgagccaccgcgcccggccaggagttggtctttatattacctaactcccacctctttcctcaatgatttgaacgtttgatcatttgaatgtttgaatgtttgatcctcgtgatcaaacattcccgttactctctagaccccatcatgctcccccaacccctccccacatcctctcagatatccaccagctctagcccccagagtaaaaacatccatcgtctccaccatcaagtgaaagcaaatggtgacttccttgcctcagccattgctgagccagttggatggcaaggaggaaaaccccacccaagccccacctaacccctgtcctccttttcatcccagccggtgcccactgattccatggttacctgacttatccactccagctcctggtccttctatcctgggtaccgctgaactgcttgggagtagcaggctgagaagttctggtgcccctcctgcagcaaggctgtcagcgggcacgggaggatgcggggaccggctggagtaagccatagccagggcaggaaggagccccacacagatctccctcagctgtgaactccacaacgacccacctcacagtcaacaacaccaatggacactcgttcctctaatcccgttattactaggcacccatttctctccacccaaggttttgttcaccatcctcaattatttattatttttttgagatggagtccaggctgaagtgcagtaacgcaatttcggctcactgtagcctctgcctcccgggttcaagcgattcccctgtctcagtctcccaagtagctgggattacaggcccccggcaccacgcccagctactttttgtatttttagtagagacggggtttccccatgtttgccaggctggtctcaaactcttgacttcaggtcatctgcctgcttcggcctcccaaagtgctgggattacagacgtgagccaccgcgcccagccggtacccccaattatttcagtattcatgatccgcaggaaggaatacatatgttttgttgttgttgttgttgttttgttttgtttcttttgtatttttagtagagatgggattttgccatgttggccaggctggtctcaaactcctgacctcaggtgatcctcctgcctcggcctcccaaagtgctgggattacagttgtaagccaccatgccaggccatgaatacatatgttttattgagttctttttttttttttttttttttttttgagatagggtctcactctgttgcccaggctagactgcagtggcaccatctgctcactgtgacctcgacctctcaagctcaagcgatcctcctacctcagcctccccagtagctgggactataggcgtgcaccaccatacctagctaatttttgtattttttgtagagacagggtttggccatgttgcccaggcttcttctttttcaatgaatgtatttacagctataaatttttccttctagcactgctttctctgcattccatacattttgatatgttggattttcatatttgtctcaaggttgtttttattttttattttatttatttttatttttatttttttgagacaatttccctcttgttgcccagtctggaatgtaatggcatagtcttcgctcactgcaacctccgcctcctgggttcaagcgattctcctgcctcagcctcccgagtagctgggattacaggtgcccgccaccacaccgggctaatttttgtatcttttgtagagatggggtttcaccatgttggccacgctggtctcaaactcctgacctcaggtatcagcctcccaaagtgctgggattacaggcatgagccaatgtgccccgcctcaatagcctcaagcaatcttgtcacttcaatcccctaaactgggactacagggaggcaccactgtgtctggcttggatcatattttaaacatctattctgcctatctctgttttttgattggaaagtttaacccatttcaatttaaaggaattcctgaggtggaaggcccaacttcagccattttaccatttgtgttctgtgtgtcttggagcttttttgttctttatttcttccattactgccttcttttctgtttacttgactttttgtaatgagactttttgattctcttatttcctttcgtgtattttctatagatattttctttatggttactatggggattacatttgacattctaagttataataatataactttattttattttattttgagacagagccttatctgtcacccaggctggagtgcagtggtgtgatcatggctcactgcagcatcaacctcctgggctcaagcaatcctctcacctcagcctcccgagtatgtgggactataggtaagggccaccatccctggctaatttttaaaaaaaatttttgtacagacaaggtcttactatgttgcctgagctcttgaactgctgagctcgagtgatcctctcgcctcagcctcccaaagtgctgggattacagacatgggccactgttcccagcaaaggtttaaatgatacctatttaacttcaatagcatagaaatattctattctattaattgagaactagtcttgctatgttgcccaagcttagatttgaactcctgggctcaagtaatcctcctgtttcagcctcccaagtagctgagactacatgcatgtgccattatgcctggttatggtataaacatactctatttccttttttcttttctttttttttttttttttttttgagacggagtttcgctcttgttgctcaggctggagtgcagtggtgtgatctcggctcaccgcaacctctgcctcctgggttcaagcgattctcctgcctcagcctcctgagtagctgggattacaggtgtgcgccattacgcctggctaattttgtatttttagtagagacagggtttctccatgttggtcaggctggtctcaaactcccgacctcaggcaatccgcctacctcggcctcccaaagtgctggaattacaggcgtgagccaccacgcctggcccagatactctatttttatagtttcctcttcttttatgttattttttaaaatttttatttacttatttatttgaggtaggatctcactctgtgacctaatctggagtgcagtggcgtgatcacggcttactgtagcctggaccttccgggctcaaacaatccttccacctcagcctcccaagtagttaggaccataggtgcccaccaccatgactggctaatttgttaatttttccatagagataaggtctcactatgttgcccaggctggtcttgaactcctgagctcaagcgatcctcttgcctggactcccaaagtgctaggattactggcgtgagccaccgcccccggctcttttatgttgttaatgtcacaaatcacatctttatatattgagtgcccaatatcatagaaatataattatttttattacttttcttgagaaagcatctcgctcttgttgcccaggctggagtgcagtggcgtgatctcagctcactgcaacctccacctcccgagttcgagcgattctcctgcctcagcctcccaagtagctgggattacaggcatgtaccaccatgcacagctaattttgtatttttagtagagacagggtttctccatgttggtcaggctggtccggaactcccaacctcaggtgacctgcctgcctcggcctcccaaagtgctgggattacaggcatgagccaccatccccggctttctttttttctttttgagacagagtctcgctctgtcacccaggctggagtgcagtggtgcgatctcagctcactgcaacctccgtctcccaggatcaagcaattctcctgcctcagcctcctgagtagctgggattacaggcatgctccaccacatgcggctaattttagtatttttagtagagatggggtttcaccatattggccaggctggtcttgaactcctgacctcaaatgatccacacacctcggcctcccaaagtgctgggattataagcatgaggcaccgtgcctggccggtcttttcttaattctttttttctgggcctctgtggtaactgtaatttcctctgtggctgcctttgaatgacctaattgtcaatgtctgggtcccaagagaaaaataaaataacaaaagtgcaaaaagaaaataaaatttcggctgagcgaggtagctcttgcctataatcccagcactttgaggggctgaggtgcgaaaatcgcttgagttcaggagtcctagaccagcctgggcaacatagcgagacattgtctctactaaacctaaaaaaatattatccgcgtatggtggcacttgcctgtggtcccagttactcgggaggctgaggtggggggattgcttgatcccaggagatcgatgctgcagtgagctataatagcaccactgcacgctatcctgggtgacagagcaagaccttgtcttaaaaaaaaaaaaaaaaaagaaaaaaatcaataccttccaaattcattatgcgaaggggaaaattaagcacttaagtcctagaaactgagtcttataatacagcttctctgatgcatgactgatgcttccttacctttgttttgagactgtagccatcagactccttgttcttcattcaaacctatactaaatgatgtaggatatgtatacccttgcgactgttaccgctttacaatagaatgttaagcaacccccatagagtgtaatcaacagtagtcaatcacatctgtttttttttttattttaatttttttttttattttgagacagagtcttgctctgtcacccaggctggagtgcagtggcatgatcttggctcactgcaacatctacttcctggattcaagccattctcgtgcctcagcctcctgagtagctgggattacaggcatgtgtcactatgcccagctactttttgtatttttaatagagacagattttcactatgttggccaggttggtcttgaacccctgacgtcaggtgatccacctacctaggtcttccaaagtgttgggattacaggtgtgatccacggcacccagcctcaaatcttatgtctgtatattaacatctgtatggaaatgtatttctgttcagcacctctgtttttgcctatatagacaattttcacttttccccacactgggatcattgatcactattcttcggtgtcagcatgtccctgatggccacccttgtactctgtgtttgaataaactcttttttttttttttttttgagacaaggtctctgtcatctaggctggagtgcagtggtgccatcatagcttactgcaacctcgatttcctgagatcaagtgatcctcccgtcctagccccccgagtagctgggactacaggtgcaccctatcatgcccagcttattaaaaacaatatatttttttgagagacagggtctcactatatggtccaggcgggtctcaaactcctgtgctcaagccgtcctccagccttgacctcccaaaatgctgggattatagatatgagccactgtgcctggccttgaataaactattttaactggatcttgagcctttcgattattttaggttgacaaagggaaaaaaataaaaggcatcagctctttatatcccccaccacgcctggctaattttttgtagttttagtagagacggggcttcaccatgttagccaggatggtctcaatctcctgacctcctgatccgcctgcctcggcctcccaaagtgctggtattacaggcatgagtcactgcacccggccaatttttgtatttttttgtagagatggggtgggagggtttactatgtggcccagactggtttcaaactgctaggctcaagcaatcctcccgtcttggcctcccaaagtgctaggattggaggcatgagccactgtgctcagcccctggctaattttcatattttttaaatggggttaggggttggtctcactatgttgcccaggctggtttcaaactcccgggctcaactgatcctcctgccttgacctcctaaactgctgggattacaggcatgagccaccatgcctggccatagattctttatgatttttattctgccatcttccctgaatcctccaacctgccttttttttttttttcaggcaaagtcttgctctgtcgcccaggctgatgtgcagtggcacgatctcagctcactgcaacctccacctcccaggttcaataattttttgtatttttagtagagacggggtttcactatattggccaggctggtctcaaactcctgacctcgttatcctcctgcctcagcctcccaaagtgctgggattacaggcatgagccactgtgcccagcttaacctgcctttttttttgagacagtttctctcttgttgaccaggctaaagtgcaatggtgtgatcttggctcaccgcaacctccacctccccgattcaagcgattctcctgcctcagcctcccgagtagctgggattacaggcatgtgccaccaggcccggctaattttgtatttttatttatttatttattttattttatttatttatttatttttgagacggaatctcgctctctctcccagtctggagcgcagtggcgccatctcggctcactacaagttccgcctcccaggttcacgccattctcctgcctcagcctcccgagtagctgggactacaggcgcccactgccacgcccggctaattttttgtatttttagtagagatggggtttcaccgtgttagccaggatggtctcgatctccagacctcgtgatctgcccgcctcggcctcccaaagtgctgggattacaggcatgagccacggcgcctggcctaattttgtatttttagtagagatggggtttctccatgttccgaactcccgacctcaggtgatccgcctgcctcggcctcccaaagtgctagattacaggcgtgctccatcgcacccagcccaacctgccttttaatactaatacattactttgggtctcatcccacatcacttcatcagagagcatccttcctctcacctcagttatttctacttttttttccacgtatagatgttttttcagggaccggagggtatgggaggaagccttggcacgcctcatcccaaatgcccgtttcccggaacatcaggcccttcctcctcttcctgtcctccctggcctagcctgggctccctcccgttctgaggcaaggcgattgctccatgtcacagtgagtgtggagttccctgcacatactggtgaccttgtgtccggaaggaattagaaggaagagctcatggagtgccagaagaagacagtgcctactctggcaagctagaagcaagctctgcattaaatgcaaatattggccgggcacggtggctcacatttgtaatcccagcacctggggaggcctaggcaggaggatcacttgagcccaggaattcacgaccagcctggtcaacatagtgagaccccatctaacccaccccacccccgtcacacacacagcaccaacaacaaaataaaattagcagagtgtggtggggcgtgactttggtcccagctactagggaggctgaggcaggaggatcgtttgagcccgggagattggggctggagtgagccgagatcatgccactgcagtccagcctgggtgacagagcaagaccctgaaagaaaaaaaagaaaggagggagggagggaggatggaaggaaggaaggaaggaaggaaggaaggaaggaaggaaggaaggaaaccaaaacaaggccacgcgtggtggctcacgcctgtaatcccagcactttgggaggctgaggtgggcgtatcacttgaggtcaggagttagagaccagcctcggtaacatggcgaaaccccgtctctacgaaaaatacaaaaattagccaggcgtggtggcgggtgcctgtaattcagctactcgggaggctgaggcacgagaatcgcttgaacccgggaggcagagattgcagtgagctgagatcgcgccactgcactccagcctgggcgacaaaagcgaaactccgtctcaaaaaaaaaaaaaaaaaaaaaccaaaacaaaccctcaaatatccctcgggctgggtgcagggaggaaactcggcctgagaggcgcagtggctagaaccagtcaacactgctacgcacagccacgtttccatggcttcctacgtcactcaggccttagggggcggggtatgtcaccctatccaatcaggggcgctggggcggggccctgccaactgtccattcagatgggcccgggagaggagggcagggcctgcgcctccctacggagcctttgtttctggcgaccgtccccacccggg

SEQ ID NO: 252 - DNA, 10000 bp, Homo sapien
cctcagtttccccacctggaagtgaggatggcagtggcacttatcttgcagagtgctgagcagatacaagggacactttagcacaaggcctacaggctggctgtcatcaccaggcacctctgcagcaggggacagagggaaggactctgtggagaatagtcctgtggctagcgtgcaatggtgactgaccacgccactgatggcagagtggccactgaatccaggtccccaggctcgcagcccatgccttctccacaagatctgtctgccccatacccctgagccttccacagaagccagggtgcttcccacaggccaggcacccagcgccagccaggtgtacagaggccagtatctgctgtgtgaatcaatcgctgaaccaactgtcaaggaccagcagcctcaggggcgggcctggtagctcggtgagcgaggaggtggtgggagggccttgtgcgggtagggaggtgacagtaagaaatggcctcttgctggatgcagtgtctcaagcctttaatcctagcagtttgggaggccgaggcggggggaatcccttgagcccaggtgtttgagaccagcctgggcaacatggtgaaactgtttctacaaaaaaaatccaaaaattagctgggagtgttggcgtgcacctgccgccccagctactctggaggtctgagcccaggaggtcgaggacgcagtgagccgtgatctggcccctgcactgcagcctgggccacagagcaagaccctgtctcaataataataataataataataataataataataataataataacaacaacaacaacaataataataataataataataataataaaataaaggaatggcttccactcattccactcctgggccagcggcccgctgtgcactccgctccctttcgctgatgccatgtgagcagctccatggcggggacctgacccctgctcctcagccccacactgcctcgcccctttgtatatcaaaggcgcctctgaggggctgtgctgacccccaccaggagcagcaggaccacctcaggcatcccagctcccctgaggcagggtctggggctggggttggggggaaggacccctcaagtctctatctgcacagacagcccacccgtgcccagggctgccttccgagcacccgcagacctgggcctgcagtaacaggagagctatctgcaaaccgcagtgtcatcagccgcacggcctctggagaggcctgagaaaggccggctcagcttgcaggcgaggaaccaaacgaaaggcaaactcctggcccctgcagcctcgcaggtcccctatccctcctccctgccttcctttccgccccgctgacaccacggtctgcaaaccatggtcctcctcgccacccctgtcacctcctcctccgccccccgccggcctccgacgcaaagtcgccacccagtcaccccgcctcggccccgcctggtttgatttcctcccgtgtgtgtcacccatgaggtggccgtgcccctggcctgtttacagctgtgcgcaagctcctcgcgacccgaaagcgagacctttgtctgcggcagctccgcgccgggctgggcggccgcacgggagggcacagcgccacctgctggtgctgccgccagagcgcgccaagctgaggagcaggcgggctccgctcacgcccccacaccccctggctgggggctgggttcctgcgatgtcttccgactccccgctgctcccctagtccccgtaggcacgcgggtacccggcctttgggagggggatcattcccaatactcctgttacgggttgaactgtgtccctgaacaaaaagatctctggtacccgtgaatgagatcttatttggaaatagggtctgtgcggatagaatccggatgaggtcatactggattagggtgggccttaatccaatgactgctatccttatgataacagggaaaattggacagacacgcacaggcggacagacacgaactgatgaaggcacagtttgcagtcacacgtctacaaaaccaggaacgaatgccaaggaaactggcagccaccagaggttggaagatgcaaggaagtatcctctcctagaaccttcagagacagcatggccttgctgacccctggattttggacttctggcctttagaactgtgagagaatacatttctgttgtgttgagccacccagcactttgtgacagcagcccaggaagctgacccgatagacactggtcccagtcatcaccctctgtgccatcaccacacctcccctccacgaatcaaccacgaccacaggacacctccttctggaatctctctgtgcccacgcactccccagatgagcacttccccttcccctggcaactccccggattcttgttacccccaccccccgccccggcatggcctgggcccaggagacagatacgaaatgaatgagtgaatatccacctttgctacttcgtcatattcagatgttcgtaaaaatctgtatgttcgtcatattcagatgttcgtaaaaatcaagtggcagcagtgctgggggttaaggaaatggggagagtgatggcagatgtgtgaggggagacaaggggcacttccaggtactcacagccaccctgggagctgggacagccaaccagtgtgttctcatgctcccagcccctgaggctcagagaggggaagccatctgggtcaccaagctcctgcctcttgccagttctgtgaccccaaactagccattgtgcctttcagggcctccccagtctcctgacctgcacaatggggatggttctaacgtctacttcctggggacatcaccacgctaatgtgagacaatactacaaaacctgttagctgcctcacagacttagagatggaaggattaggaaggaaaagggccttcagagactgcagggtcctgctgacccctggattttggacctctggcctttacaactgtgaggaaagaaacttctcacaggggcgagacacagcccggaatacaagtcggacaggctgggcactggtgctgtgatctggggaaagtcactcccttcttggtctggtttcctcatttgcaccatgaacgggttgaaaatgaagcaaaaatcagatatcggccccctgtggcatatgggagcatcttccaatgggaacaccttccaatggctcccatgatgtttgtttgtttgtttgttcgtttgtttattgagacagggtctggctccgtcgcccaggctggagtgcagtggcatgatcttggctcactgcactcatcacctcccaggttcaagtgattttcctgcctcagcctccggagtagctgggattataggcacctgccgagacacccagctaatttttgtatttcttttttgtagagacggggtttcaccatgttggccaggctggtgttgaactcctgacctcaggtgatccacccgcctcggcctcccaaaatgctgagattacaggtgtgagccaccgcgcccagcctccgttatgtttagaatcaggcctgactgcctcctctcagacactgtcccaggcagcctccacactggccccagagatccctgcctcctggtacataagttgctgagtgatccccttcctccgagggtgattggatttagtgactggcttctcaccaacagaacacagcacaggtgatgtgaggtcacttccaagatttacaaaaaactatgacttctgtcttgcttgtttgctcttgttttcctccccaccttcacccctcactctggggaagtgagttctgatgccgtgagctgcctgccctacagagagacccacatggcagtgaaccaagggagggcccccaccaacagtcacagaagaactgatgccctcagtcaaaactgaatcctgccaataacatgagaatggcctgggggcgggtcctgcccagtccagccatggatgagaccccagtcccagcctcccttgagacctgggggcagaggcacccagctgagctgccctggatctgggtccacagaaactgtgtgatgatcaatgtctgttgctggaagctgtacattagggtagtgttgtcacatagctgtccacaggcccctgggctgcccctcccacccccagctcacttgggccacactggcctcctttctcactcctctctggccaaactcatttctgcctcccagccctgcctgctgagccttctccatcacactgtccagactcgtgcagggctggcccatgctttgtcttctggtcacagcacagatgtccccttagcgagacctctcagatccccacccagcaggccccagccctccatggcagccccggcattattttcgctgcagcactgctttttcctttctgtgcctgtttgcttttgtgccctgtccatcgccccctccagactgccagctctggagggcaggcccccctgggtcactttcagagccacgcccaagcccaacgctgcccccccacaacccagggtgagtgcttgggcacacctgctgaagggaaagaggaagctcttggagccccctcccgcctctgagcagctaacattgtggagagggatgctagtaatggggggtgtgcattgggtagaggccggggtcccccagagggaccctgccgggctctccctgactccagttgctccaatgagtacagtgggcactgcctccccctggtggccggcactagcacagcagcagcagcctcaggcagaaaacccagaaaacaaaacacacacctttgtttgggtgttgtcaaggtagcagctctcctgagtcccagggggtcaaaggagcagaacctgcaggctccaggggtaattcaaggcgcctcagaagcttcatttgctcccctctttccctctgctggtcctggggtgtccagttcactcgtgaggcctcctcactccaaccagggcaacggctctggccccacttccaaataagaaccctgaggctccaacaaggacagtcttgtcccacaagagttgtccagtgcttggccacgctctgcaccaccccaggccctcagcccttcagcccccccggcttctcttgctcagaagaacctccaagaagaaggcattttccacagacctcggtgggtagtgggggcatccccagtggagacctaaggccgacagacacgtctacgagcctgtgggacccttggagtcacccaggccaaacattccaatttatagagcaggaatttgaggcttcctttcctacagccccgtccacactgaaggggtcttttcctgcttccaggtgatcacagcggtgaacacagaaccccacaatctgtcctctccaggctgccccagcccagacagatcctgggaaccttggagaatccccgcccatcaagctggcgtgtcctccccttgccccccaccccgtgccatggccccaggcatgttgctgggtactggatgcccctgcccgtggcagagtagcccccgccctctttcttctttcccccagtcacttccccagcgtcccgtcctactctgagccccaggaagtgtgtggtgtgtgtgtctgcgtgtgtgtgagcatgtatgcgcaggcctgcgcctgtacgtgcgcggagaagcccaggcaaatgagcccacatgggagatgggcaggggtccccaggatcttagaggctgtcattcccaaagcaaaccccacgggaagggtgagccgagcccttcctggcctaagaggccggaaccctcccttcatctctggactccgccaacttcgtgtgccccgggcgagtccctgcccctctcctgtcctcagtttccctactgtcccgggcggggttggacgcggagctgcgtaagcgcacgctcagcgtggacgcggcgccgggctccctccccccggtgggtgtgggctggggcatacggtcctccctccacccgcgacgcgaggctggggacggcgcgcactcacctggcaatctaccatcatcctcagcctcggtggcacatcgccggccccagggcgggacccggggctcgcagaggccgctcgcctgggcccgcgcgcggcgcaggggtgcgcccggctgcggggctcatggcgcggcctccggtccccgccgggcccaggactctgcggccctcggggccgccccggcagccgccagcgccgctcccattgtctgcgccgcgccgcgctccggccgctcgggcctcgccgctcggttccgccccggctccccgggctcgggcccgggtgggcggggacagccgcggccccgccccagcccgcccgcaggtgcgaggggcgcgccccgccgcgtgagctcggggacgcgctcgggggcgcgctcaggcctccctcccgcgggccgacgcgggtgttccccccgcggggcagccgggcctgttgtccaaggccgggcgcgcacacggggcctgcgcgggaccgcagacagcgcgtgcacgtcactccgcttcgccgcgcgcacgcgccacgctcccagcgccatgtgcggccgatctcacgtgtccgtccgccccagccgcctgctcagtactccccaccccgctaggacctagggccaacctcgccccagccaggcgggggccgctgagtcggcgcgccggcgtcaccaaatatacacgttcaccctggcgcccagcaccccgatgccacctgctggactcggctcggcggatggctgggagctgggggacccgaggtgacagcgaactcagcctgggcagggagaaagtcaggtctccccttcccctcctcttccccacctccctccttgtcttccctgacagcacccgggaccacaaggtccagctgcagcttcagctggtgtaagatggggctcaagggagcctgggggaaggaggcctcacactggggttgagcgactgttgggggtagtcagtgttattagggctaactgatttcgtccctttttattttttatttacttttgtttttgagatggagtctcgtttgtttgttttttgagacgaagtctcactcttgtcccccaggctggagtgcaatggcgcgatctcggctcactgcaacctccacgtcccaggttcaagcaattctcctgcctcagcctcctgagtagctgggattacaggcacctgccaccacgcccggctaattttgtatttttagtagagatggggtttcaccatgttggccaggctggtctcaaactccagacgtcaggtgatcctcccaccttggcctcccaaagtgctgggattacaggcatgagccactgcaccagccgcagtctccttcttgtcgaccaggctggaatgcagtggctagatcacggcttattgcaacctctgcctcctgggttcaagcgattctcctgtctcagcctcccaagtagctgggattacaggtgcacgctgccaccaccacgcccgactaatttttgtgtttttagtagagacagagtttcaccatattggccaggctggtctcgaacttctgacctcaggtgatctgccctcctcggcctcccaaagtgttgggattacaggcgtgagccactttgcctggccaacccttttgatttatttatttattttatttttttgagacagagtctcactctgtcacccagactggagtgcaatggcacagtctcagctcactgcaacctccacctcccaggttcaagtgattctcccgtctcagcctcccgagtagctgggactacaggcatgtgccatcacacccggctaatttttgtatttttagtagaggcggggtttcactatgttggccaggctggtctggaacttctgacctcgtaatctgcccaccttggcctcccaaagtgctgggattacaggcgtgagccactgtgcccggccttttttatttttaaaaaaactatgtagagatgaagtctcactatgttgcccaggctggtttggaactcttgggctccagagatcctcctgccttggcctcccaaagtgccgcaattacaggcgtgagccactgtgcccggcttcattcaattttataccagagccaaggcaccagcactgcaggccactcagctgtaagtggccaggccctgctgtgcgtggtgacccccacttcatggctcttccccgtcactcatccccgagctggtcatcagaggcctcatcctgtgttggggcctcgctggccaggtatcccctgagtccagcgcttgggccccatatatattgatccccctgctgggacaggcctgcggtgacccctgcctcctagcctggcattcagaaccctgtgtgacctggtccctataccccaactctagcctcctggggccatcctgacccagggaccccatcaagcccctgcccctctcagagccccctgccagcactgcccctccctgtatcctcctccacaatgcactcaccttcagagctgcactcctcccaccctgtgcagagcacagtcttgaacccagatgacctgggttcaaacctgcagctgagccacatcacaggcaagctcatggtgacctctcagagtctcagtttcctctactgaaaatgagtcagggactcccacccgggagggtgtgccaggggtaaagctgggtgtaagtggggtgaggggggtatgggggacttctcccctgctaggtggagctgcccaggcctcagagtctgctgtcacctcaggtcccccatctcccagccatccacccagctgagtccagcgctccatggccctctctgtgctttcaacagaagctcctcggaggcagggcctactccttcagcacagaacccctcccctggagcaggtgctccctatgagggacacagaggccatggttccattcctgcccctctgcccaggaggcactcagtgccccttcaagactccaggcctctccagcccagtctgtctcctccaactggtcactccatctgtccacgctcttcgggtctgtccctgctcgccagccaaaccacaggtgaaggaagaatgaactcagggctggccccagcttttccacgggtgaccaagtgggtgggtgcctgcccgttccagtatgaccagagtctaccccaccctcctttctgtcttctccttccatgaaaaagatgctgctgtctccagggcggtgagcaccaggccgccaagccctgaacccataccccaccccatctctgcgtggccaggcagacagaaccacactgtaggcctctgaagtccttctggatccagactggagaggtcatcttcccatgccctctaatcctggcctgcaccattggctcagagtcccacgcccactggtgacctcacagggctgcagtgaccctggatacgggagctcccagggttgtccggctgctgggctccatacccctctacacagttgggagtgtggtggctctgccagcatgctccacttcacccagtctccctggagaactggaatgaaatcctgtccgttgtagcctctagctttagctcagattttctggagtaactatatccctattcgattgtgtttgacttccagtctgcctgtgtccccactgcctgatggaacagacactggggacacaggcaggctggatgtgcaggtaaaaaccaccttagtggccgggcacagtggctcacacctgtaatcccagcactttgggaggtcgaggcaggtggatcacttgaggccaggagtttgagacaagcctggccaacacggtgaaaccccgtctctactaaaaatacaaaaattaactgggtgtggcgggcacctgtaatcccagctacttgggagtctgaggcaggagaatcgcttgaacctgggagccagaggttgcagtgagccaagatcacgccactgaactccagcctgggtgacaagagcgaaactcggtctcaaaaaaaacaaaaacaaaacaaaaaaaatcaccctagctagggttgagcacacgccccctttattataaac

SEQ ID NO: 253 - DNA, 10000 bp, Homo sapien
  misc_feature 5904, 5905, 5906, 5907, 5908, 5909, 5910, 5911, 5912, 5913,5914, 5915, 5916, 5917, 5918, 5919, 5920, 5921, 5922, 5923,5924, 5925, 5926, 5927, 5928, 5929, 5930, 5931, 5932, 5933,5934, 5935, 5936, 5937, 5938, 5939, 5940, 5941, 5942: n = A,T,C or G
  misc_feature 5943, 5944, 5945, 5946, 5947, 5948, 5949, 5950, 5951, 5952,5953, 5954, 5955, 5956, 5957, 5958, 5959, 5960, 5961, 5962,5963, 5964, 5965, 5966, 5967, 5968, 5969, 5970, 5971, 5972,5973, 5974, 5975, 5976, 5977, 5978, 5979, 5980, 5981: n = A,T,C or G
  misc_feature 5982, 5983, 5984, 5985, 5986, 5987, 5988, 5989, 5990, 5991,5992, 5993, 5994, 5995, 5996, 5997, 5998, 5999, 6000, 6001,6002, 6003, 6004, 6005, 6006, 6007, 6008, 6009, 6010, 6011,6012, 6013, 6014, 6015, 6016, 6017, 6018, 6019, 6020: n = A,T,C or G
  misc_feature 6021, 6022, 6023, 6024, 6025, 6026, 6027, 6028, 6029, 6030,6031, 6032, 6033, 6034, 6035, 6036, 6037, 6038, 6039, 6040,6041, 6042, 6043, 6044, 6045, 6046, 6047, 6048, 6049, 6050,6051, 6052, 6053, 6054, 6055, 6056, 6057, 6058, 6059: n = A,T,C or G
  misc_feature 6060, 6061, 6062, 6063, 6064, 6065, 6066, 6067, 6068, 6069,6070, 6071, 6072, 6073, 6074, 6075, 6076, 6077, 6078, 6079,6080: n = A,T,C or G
ttgtatttttagtagagacagggtttcaccgtgttagccaggatggtcttgatctcctgaccttgcaattcgcccgcctcggcctcccaaagtgctgtgattacaggcatgagccaccatgcccggcccgttggcaatctttcttccgacttctgaagagaaccactctgttttagagcagtgtttctcagaggggttattttacctttcaggggtcttttcacaatgtctggagacatttttggttgttatagctgggggtaggggtgctactagtatctggtgggttgaggccaaggatgttgctaaaatatcctacaatgcaaaggacaccctctcacaagaaagaatctggaccaaaatggcaattgttttgaggctgagaaaaccctggtctccctatagggaagtgcagtgcctctacggcttcaatagccatttatgaaaaatccccaaatttattatctccagcccgggcctctccctcaactaccaatgctgcctctccaatgccctggacagttcacagacacctccaacacccaaaccaaaccctttatcttttctccatgttcctcctcctgggtgggactcccattctacccgcttctcaagctaggaaccacaaagcatccttcacatgcaaggtcgtcaccaagccttagttcatacttttttaaaaaaattttttacaagggcacaaaaatcaggcaattggttcattcttggtcgtgcctctcatatccaccacctccttggtccaccagctcctgcctcctggttaatgccagcagcacgatctcttccctggacaattccaatcccctctaaattcacctttcttttcccatctacccctctgtggttgattgctatcttccagaaacacatattgtatgctccaccctgcctccaggataaagcccaaacttcttagcatggcattccaagactgttctcaacctgcttttctgaacttctctcccattagattcacctcccagccctccagtcaaccaaattacatgtcctttctcaaacgtcgtacaccatccaccttctatatctttccctaaggccttcactcatcactgcttatgacaattctattcacatttaagacatagcctccatgaagctttagagatttccccactgaagctaacttgttcctgttctgatctccatcacattttatttcttttaaagaatctttcacatactttgtcatacatatttgacccctccaacactcttaagtcctataaaggcaggcagggactgagtcctcactttggtaccctttgtagtatatgacatatgtcctagacatgtaggcaactcactaaaggtttcagatattgaactgagaagtctgaaagaaagctgctttctccacagtacagagaaagatgatttttgttggaaaagatttatagagaaatttctttcctaaagtttgacctattttatggataaatgaatgctaaatatcacaaatctttgtatattggtcctgaaaggaaaacctggagatactgagttagcaagctcatttattagctgtatttttcttttcttttcttttctttttttttttttgttttgttttttgagacggagtctcactctgttgcccaggctggagtgcagtggcacaatctcggctccctgcaacctccacctcccaggttcaagcaattctctacctcagcctcccaagtagctgggattacaggcgcccgccaccacgcctggctgatttttgtatttttggtagagacggggtttcaccatcttggccaggctggtcttaaactcctgacctcgtgatccacccacctcggcctccctaaatgctgggattacaggcgtgagccactgcgcccagctattagctgtatgtttcctatacagaatactcttgttcacccaagactattaagaacttttgatctccagctgggcaaggcggctaatgcctgtaatcacatcactttgggaggccaaggcaggaggatgccttgaggccaggagttccagatgagtctggccaacataatgagaccccatctgtacaaaatatttattattttattttattttatttttgaaacagagtctcgttctgtcgccaggctggagtgcagtggcgcgatcttggctcactgcaacctccgcctccagggtttaagtgattcttcagcctcagcctcccgagtagctggaactacaagtgcctgccaccacgcccagctaatttttgtatttttttagtagagactgggtttcattatgttggccaggatggtctcaatctcttgacctcatgatctgccagcctcaacctcccaaagtgctgagattgcaggcgtgagccactgcgcctggccgattttattttttttttattttatcttattttattttagagatggagtctcactctatcacccaggctgcagggcagtggcacgatctcagctcaatgcaacctccacctcctgggtttaagcagttctcctgcctcagccttccaagtaactggaattacaggcatgcacaaccatacctggctaatttttgtatttttagtagagatggcgtttcaccatgttggccaggctggtcttgaactcctgacctcagatgatccacctgccttggcctcctgaactgctgggattacaggtgtgagccaccgggtctggccaaaatattttttaaattaaaaaaaagtttgaaaagaacgtgatttccctctctccttttaaaactgcactcatccttcaaagcccaagtgagaccgggagaccctgtctcaaaaaaagctttcctgatttctctagtgtaattcatttcttcctcaatgcttccattgcactcatttaatagtatttatgactttctacattctattactgttattactatcctattatttctaaattattttattattatcatgtttccttaccatttaactcctagaagacagaggctacaattgagtcatttccccctctctgtaacttgttcagtccttagcacataacagaccataaatgctgaatttactggaagcattaatattgagcagtcctagacgagtggatacaaatttcctaagccaaactgaatttgtttgggccagtatttgacagtggattaagaaatacatctcagactgggagcaatgactcatgcctataatcccagcactttgggaggccaaggtgggaggatcacttgtgttcaagagtttgagaccagcttgggcaacatagtgagaccctgcctctccaaaatataagaaattagctgggtatgggggtgcacgcctagtcctagctcctcaggaggctgaggcgaggagatcgcttgaacccaggatgtcaaggctgcagtgagctgtgatcatgccactcagcctgggtgacagagtgagaacctgtctcaaaaaaaaaaaaaaaaaaaaaagccaggtgtggtggcaggtgcctgtagtctcagctacttgggaggctgaggcaggaggatcactagagcctaggagttctgggctatagtgtgctatgcccatcgggtatctgcactaagttcaacattattatggtgacctcccgggagcaaggaaccaccaggttgcctaaggagtggtgaaccggcccaggtaggaaacagagcaggtcaaaactcccacgctgatcagtagtgggatcacacctgtgaatagccactgtactccagcctgggcaacatagtgagaccctgtctctaaaaagaaagaaagatgggtctgggcatggtggctcacacctgtaatcccagcactttgggtggccaaggcgggtggatcacttgaggtcagcagtttgagaccagcctggccaatatggtgaaaccccatctctattaaaaatacaaaatttagacaggcgtggtggcaggcgcctgtaatcccagctacttgggaggctgaggcaggagaatcacttgaacccgggagacagaggttgcagtgagctgagattgcaccactgcactccagcctgggtgacagagtgagacttggtctcaaaaaaaaaaaaaagtgacttgacctgccttgcctgttagaataacctagaaatgagctatatcctcaatagcaggaacacagtttgcctggtgattcctcctgctagaaatccatctggtaccaatagtcccttttatatgtctacctctgccattcttttcctttaggacaatagttctcggtggatggcctagaaactcctggggtcttcaaagacaaaattactgtagtaatactgagatatttacctttttaacagctagcatttgtactgatgatgcaaaagcaatggtgggtaaaagtgctggcaactaagcaggaatgaagaccatggcaccaaattgtagtagtagccattgcattcctcaatgccatgcacttgcaatttttaaaaatgccactttctattaagaacgtccttgatgaagctgggtgtggtggctcacacctgtaatcccagcactttgggaggccaacacgggtggatcacctgaggtcacgagttcgagaccagcctgaccaacatagagaaaccccttctctactaaaaacacaaaaattagctgggcatggtgggtgcgtgcctgtaatcccagctactcaggaggctgaggcaggagaatcgcttgaaccagggagtcaggttgcagtgagccaagatcgtgccactgcactctagtggggcgacatagtgagactcggtctcaaaaaaaaaaaaaaaaaatgagtatccctgatgaagcagtacaaattattaattgtattaaatcttgaccctacagtacatgtctttttaatattttgtgtgaagaaatgggaaatatgcatatagcacttctgcatataatagttgtctcatggtttgtcaagaaaaagcacttgtgcaattaaactaacctttggcctggtgcagtggctcacgcccataatccaaacattttgggaggccagggcaggaggattgcttgagatcaggagttcgagaccaacctgggcaacatggagaaaccagatctgtacaaaaaattagctaggggtggacacctcacccggctacttttttgtatttttttgtagagatggggtttcaccatgtcatccaggctggtctcaaactcctgacctcaagcgatcctcccaccttggcctcccaaagttttgggattatgggcgtgagccactgtgcccagcccctctgcctatttttatttgggttgtctttttcattgttgagttgcaggagttctttacatattctggatactagaccctcatcagatatggttttaaaatactttctctcattcttttcactttcaagtatccctttgatgcacacacccaaaaaagcaaatagtgtccaattgcattctttgatgaagaagaatacaagcagtaagtcaattacagcctatttttttcttttctttctttctctttctctctctctctttctttctttgagacagggtcttgctctgttgcccaggctggagtgcagtggcacagtgacagctcactgcagcctcaacctcctgggctcaagcggtcctcccacctcagcctcctaagtagctgggactccaggcgtgtgccactgcgcctggctaatttttgtattttttgtaattttttgtagagatggggtttcaccatgttgcacaggctggtctcgaattcctgagctcaaataatcctccctcctcagcctcccaaagtgctgggattacaggcatgagccactgtgcccagtctatggttgtttttaagttaacagactagtgccgggcgaggtgagctcagcgcctgtaaatcctatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtggtgcgcgcctgtagtcccagctactcaggaggctgaagcagaattacttgaacatgggaagcggaggttgcagtgagccacgattgtgccactgcactccagcctggcgacacagcgagactccatctcaaaataaataaataaattaattaattaattaacagactattctggggggacaattttagccttacagaaaaactgagcagaaagtacagagaattccaggctgggagtaatggctcaagcctttaatcccagcactgtcggaggccaaggagggaggatcacttgagctcaggagtttgagaccaggctgggcaagatggtgaaaccccgtctctacaaaaaataaaaaaaattagccaggcacagtggtgcacgcctgtagtccagctacttgggaggctgaggttgaaggatcacttgagcccagaaggacaaggctgcagtgagtcaagattgtgacactgcccctccagcctaggcgacagagggagactctgtctcaaaaaaaagaaaagaaaaaaaaaaaaagaagaagaagaaagtaccgagagttcccatatcccccttcaggctccccatttttcctattattaactttttgcattagtgtggtacatttgttacaactgatgagccagtattggtatattattaacatagcccagccgggcgcggtggctcatgcctgtaatctcagcactttgggaggccgaggcgggtggatcgcctgaggtcaggagttcaagaccagcctggtcaacatagtgaaaacccatctctactaaaaatacaaaaaattagctgggcgtggaagcgggtgcctgtaatcccagctactcaggaggctgaggcaggagaatcgcttgaaactgggaggcagaggttgcagtgagccgagatcgcatcattgcactccagcctgggcaacaagggggaaactccgtctcaaaaaacaaacaaacaaaaaaacatagtccatattgatacattataattaactaagtccataagttacattaggctttactcttttccacacacaagtatgacatgtatccaccatgacactattacatcatacaaaatagtttcacttctgtaaaactcccctgtgctccacctaccatcccttcctccccccaactccacttccctggcagtcactgatctttttattatctccatagtttagccttttcagaatatcatacagttggggccaaacgcactgcctcatgcctgtaatcccagcactttggaaggctgagcaggaggattgcttgagaccagaagtttaagaccatcttgggcaacatagcaagaccttgactcaaaaaaatacatatatatatgtcatatggatggaatcatagtttgtagtctttccacattgatttctttcgcttagcaatatgaatttaaggttcctccatgttttctaatggcttgatagctttttttttttttccttgagatggatcccattatgttgccccggctagtcttaaactcctgaactaaagtgattgtcttgcttcagcctccagaaaagctgggaatagctgagactacagaaacatgccattttttttcctttgtagtagaagttagaaagcttttttttttttttgagatggagtcttgctctttcaccctggctggagtacagtggcgcaatctgggatcactgcaacctctgcctcccgggttcaaccgattctcctgcctcagcctccccagtaggtgggattacaggcacgtgccaccacacccggctaatttttgtatttttagtaaagacggggtttcaccgtattggtcaagctggtctcgaactcctgactttgtgatccacctgcctcagcctcccaaagtgctgggattacaggtgtgagccaccgtgcccggccttttttttttttttttttttttgagacagagtcttactctgtcacccaggctggagtgcagtggttcgatcttggatcactgcaacctccacctcccgggtacaagtgattctcctgtctcagccttctgagtagctgggattatagacgcctgccaccacacccggctcattttttttgtatttttagtagagacggggttttaccatgttggcgaggctgatttcaaattgctgaccttaagtgatccaaccgcctcggcctcccaaagtgctggaattacaggcgtgagccaccgcgcctggcctcaaaaaaaaaaattttttttttcaggacggcgtcttgctctgtcgcccaggctggagggcagtggtgcgatctcggctcactgcaagctctacctcctgggttcacgccattctcctgcctcagcctctcgagtagctgggactgcaggcgcctgccaccacgcccggataattttttgtatttttagtagagacggggtttcaccgtgttagccaggatggtctcgatctcctgacctcgtgatccactcgcctcgtcctcccaaagtgctgggattacaggcgtgagccaccgcgcccggccaaaaaaatttctaatacggcaaatattgaaagatataatccacataaacaaagcttttagggtcttctataatttctaacactgtaaatggttcccaagacccaactgtttgagaaccgcttctctgggatgccttcttcttttcctgctggctaatcccagtggagagatttaggtatttaattctgctccagactcacctctgagaaccttccctgatgggccacactctactcactgcccttgctctgtatcccctcttcagttatgttgttcctgtttccctggctgcttttaattttctttctttcttttcttcccgccttttcttttctttctctttctttttcgttttttgttttttgagacggagtctcactctgtcgcccaggctggagtgcagtagcgcgatcttggctcactgcaacctccgcctcctaggttcaagcgattctcctgcctcagcctcccgagtagctgggattacaggcgcacgccaccatgcccggattatttttgtatttttagtacagacggggtttcaccatgttggccaggctggtctttaactcctgacttcaagtgatccgcccgccttggcctctcaaagtgctgggattacaggcttgctgccgcacccggcttgtttttttttttttttttttttgagacggggtctcactgtgtcccccaggctggagtgcagtggtgcgatcacagctccctgcagcctcgaactactgggctcaagcgaacctcccacctcagcctcccgagtagctgaaaccacaggagcgcgccacgacacacagctaactttttttttagtgttttttctttttttgttgttgccttttttttttttctttatcgatcctcccgcattggccttccaaactgttgggattacaagcgagagcagtgcccggcccctactgctttgaaacctcggttctttgcaggtcctggaaaagaaagtgaaggggtcgtgcaatggctcaaaacccaggcaacatttccaggcgcgtcctcaactcggcgtcactctgacaaaaagtttgccctttgcgcccgatccctcacaccagagagcaccgcagggacgcagggacggagaggactaatggggtcggggaggacccaaggaagttggggaactcagactcttttcagtgtttaaaaagcagaggccccctcggaaggcataacaggcgagtctaacaatgcccctggagatcaacggcactaaggggtacctttgccccgctccaaggctccttgttccgccccctgccgccaagcaaggaatccggcgccgccggtcgtgggtagtatttacgacagtgctggcgctttgcggccggccgcacagccgctgacgcg

SEQ ID NO: 254 - DNA, 10000 bp, Homo sapien
tcacacacagataccagcttttaatcaaacagcagtttttactgagctccaggtggggctggcccagcatggccagtacagcaggctgccctcaagggccagtctgtggcatgacaggaaatgcaggggtgcacatgttggggctgccctttggcactcactggggtgggtcaagggagagcaaacaccaaggtcctctggagaccagaatcggccagtgcagccatttggcttctccttcaggaccagctgggtcagttcccaggccctgaggcaatgcctgcatcctgggtccgtggggcactactgctgtcactgctctgagggagaaagacgaccagcagcacaatcaggatgatgagcaggacaccaaccaccaccagccccacgcagatccggtaacggatgttctcccagcacttcttctgggccaggttctgtgtagtcttgttgaaggttgagctctgcggatacccccagacacaaagtgggagttagctggcaccctcttggcctgggagccagctcctcccaaccccatctcagtaaggcttagtctcctcctgcatcctccccatcttgtctactttctttcttttttttttttttttgagaaggagtctctccctgtcacccaggctggagtacagtggcacaatctcagctcactgcaacctctgcctcccgggttcaagcaattctcctgtctcagcctccctagtagctgggactacaggtgcacaccactgcgcccggctaatttttgtatttttagttgagatggggtttcaccatactggctaggatagtcttgaactcctgaccttgtgatctgcccacctcggcctcccaaagtgttgggattacaggcgtgagacaccgcgcccggccttgtctgctctctttctataccacctgccgtggaaccctcccagcctgactcatctcaaacaccggtgtggcccttgactttcagccctagtgtctcaccctcagttaacaatgccagtactcaggctggacacagtggctcatgcctgtaatcccagcacattggaaagccaaggtgggaggatctcttggatccaggagttcaagaccagcctgggcaacatggtgagacctcatctctacaaaaaatcaaaaattagacaggcatggtggtgcaggcttgtagtcctagctcttcaggaggctgaggcaggaggatcacttaagcctgggaggtagaggctgcagcaaatatgattgtgccactgtactagcctgggcgacagagtgagactctgtctcaaagtaaaaaagaaacaaaaaacgataccagttttctacctttaagaaggtccacagcttcaaaccaaggccttcttatcttgtggggtctatctgttgcatgtctaggctatgggtgcctgaggaaacccagaggccccacactggccctcaagaaggcctcaaccccaccaaggaactggagatcctgaatacagcccaagagagactttcccaatcctctcccctcccctccatgctcccccaggcctcacaccatatccaggagttggtctgaacgctgctgcagttcggccagcttcacaccacgctccaggaccttgccgaagttgttacgcataatttccgtcacctcgttcgcctgctgctggcaccgctccaactctattcctgcctggacaccaagcccgaggtcagggctgcatgaggcccccacctggccctcatctgcccctgagatctagaagcctccttctccccctgtaggtgggtacagcatgagagtaacagcatccttcgtgtaagggtatgatgtgtgcggagtgaaggtctggccttcggggtgagtgcggcacaccttaagtctcacaggctcctccccttgcacgtcaaggcagggcctaggacctaggtaagtcccggcttccagcacctcagcttcctctaagctgtcccaaggtgggatcttcccaggaccccaccctcccacaaagctgattcttttctcacctgctccagaatggcgtctacccaatcaatgcacagctgccctaaggtttcccactggcctaagaaggcagcaaagaatgggtaaccaagctacctggctggaacacacagggaggagacctaccctacaggctagaaaggtaattttgaagcagcacacatcatagtctctgcctaacccctctatccccaaactgagaagctcagatcttcctctttgggcctctgactggtcaggccagttctgcctcctggcctgatcctgctccctatatcactgctccaacttccctctccgtctgggaacctcagtggtaccggtttttggcctccagccttccactcagctggggtcctcactggggtccaacttacagagatgagactaactcttggatttcccagcctggggggcagctttgcctaacagaaaacaccagctcatttcagaggactgggaagggaggtcttggatccaagctggggaaggttgaaatgacaggggagagagaaagtctgggtcatgtgcaagaaaggcactgggctttgggtgcacgtaacagagagagacaccaggcaggaggccctggtataagccagaagcctaggagcagggacatttcagggagatgaataccagtggattagcaaaccacagaaactccttcctcttagcctacttccccacagcccatccctgttcccttcccctccttacaagaagggcaagcttcttttcctgccagcccacgtcacccattgtctacaacagacattttggcacttgactgaattccacttaaaaccagaaaacttaagtgttagaagagatctggtggtcacagagggctacctcccactcagccaagaatcctccttcaggatccttgcagctgcttggtatacagcctccaagaattcccactgtatgagtcctatctccccagctggaccacaaactcccagagggagggcagggagcagtgccctgcctttgtccaccaccatcccaccgggaggccagcacagtgctgaccattgcaagcaaggaatcagtgagtgggccaattacgatacagcctaaccaaaagcaattcttattctcaagagatgttctcccagcatgtttttctagccctgcatgagtttcgaggggcaggcatttgaaacccaaataggtcaatatttacccatgagctagaaaagcaacctgcttcaagagaggtcaggcaaaccactgtaggggaggctgcgctcacaggctggaggaagcagtaagcaggaaacacagaggaacaacgaagagagcagggaaactgcactctcaccttttcctgagtcaaccgtcatcactattattactactatagcattcaacaaggctccatcattcaatcctttgaacttccccacattcaaatactccaaggcaggctgggcgcagtggctcacacctgtaatcccagcactttgggagccccaggcaggcagatcacttgaggccaggagttcgagaccagcctggccaacatggtgaaaccctgtctctactaaaaatacaaaaattagccaggcatggtggtgcatgcctgtaatcccagctacttgggaggctgagatgggagaatcgcttgaacctgggtggcggaggttgcagtgagccgagatcacaccactgcactccagcctgggcaacagagcaagactccatctcagcaaacaaaacaaaacaaaaaacaaaattaaatagtccaaagcaaaaacttgagaatggataaatactcgaaaataagagtcactgctagagactgggaaaatgctggatattatctttttattttctattctaaatgctacagctgttgttaccttatttttcaacaaggggtgatatttgggtcacattctccaaagagctggctgtgcttccagctgtaatctggaccagtctcccccaatgcgaagccaggcctgcctggagccaagatggacccaggcctaaaagaacacattcgctccagggaacacagaggccttagactcaagtctcgggccctccttggcccccactcaaccagaggaaaaaggacactgactatatacacaggtctctgctggcactgtgagaaataaagctccagggaccctggaaggaggtaagcaagaggacaagggccacactgccttacgccacactgtcactcagcataatgtctgcagacagcagagatgtgataaacagttcctgaataaatggtgcctatatttttaaagatggggtcttgctatgttgcccaggatggtcttgaactcctgggctcaagcagtcctcccacctcagcttcccaaagtgctgggattataggcatgagccatcatgcctggcctaattgtgcctattcttaaagagaccactttgccctggggaaaagacacatgtaatacaattagagaagagtaaagagttacactgtgcgatacagatagtaagtatcagagctgccacagagagggtgccatggtgggggcgggtgaccccttgaaggatgacatggagcagggacattcttgcactgagagatagggatacaccctgacagtgaggaccaggcagaggatgggagggatggggcaggacagaaggcagaaaaggtcaggtagagaagactggctccaagcgactgataaaacttaagagctagtgtggtttttgagccacgggtgacagtgaagaagtgcttcaggataatttctctattggtggtagacaggcacagatagaagtaagaaaatggcagagaggccagccagaggggtggagaagtaccatcagcaagactgccaggagatggccaccaggcgggagaggggtgacaagcagagcgtggagaaaggaagaagggtgagacaggcatttctgagacctgaggccagaagcctgcagggcttggaattttgagccagggcgagaggggagcagttgtgtaattgccagagagtggcagttacacaggaaatgttcttgacagactgttgccccctgtacagaatatcccctctatgacactcaaacctctcaggtttttctgggctcaatctctttgattcctcctatgaaaacgcagttctcaaaaccacaccatctgggccaggcacggtggctcatgcctgtaatccctggactttgggaggccaaggtgggcagatcatgcctctaccaagaaatacataaattagccaggcaaagtggtgcctgcccatagtcccagctactcgggaggctgaggcaggagaattgcttgaacctaggaggcagaggctgcagtgagccaagattgcgcactgcactccagcctgggcaaaggagtgagaccctgtctcaagaaaaaacaaagaaacaaaaacaaaaaaacctccctatcctaactctccttgtctccccatctcctgtctagtatccaagaaactgttctaactgtcgtcagatgaatgggcgcaagtaccggtataacattgcctccctaagtcggcactcagctcagagactaggagcagggctctgctttgcacccgtctgttgaaatcctgcttctgccactcaccagctgagtgactgagactgaggatatgacctttctgacctccacttcctcttctgtaaagtgctgataataatgttagctaaggattatgtgacttattgtaaatcaaaagcttagcacaacgcctgacacatactaaatgctcaataaataagagctattatattgatgtggcccacatttccctagctcctttttttttttttagcagtcagatctcaagaattgtacaatatggccaggtgtggtggctcacgcctgtaatcccagcactttgggaggccgaggcaggtggatcacaaggtcaggagtctgagaccagtctggccaatatggtgaagccctgtctctactaaaaatacaaaaattagccaggcgtggtggcgggcacctgtaatcccagctactcgggaggctgaggcaggaggatcacttaaacctgagaggcagaggttgcagtgaactaagggccactgcactccagcctgggcgacagagcgagattctgtctcaaaaaaaaaaaaaattgtgtaatacaggtggtcagtaaaacctcttcgttttataaaatgcacagccaagcaagctcttccctatggcaaacttgtacacatagtacacataattgtttctaacctgtggctcagaactttaaatgggcttttggtaacttggtaactagcatctagtttattttctttctttttttttttgagatggtgtctcactctgtcgcccaggctggagtgcagtggcgtgatctccactcactgcaagctctgcctcctgggttcacgccattctcctgcctcagcctccagggtagctgggactacaggcgcctgccaccacgcccagctaattttttgtatttttagtagagacagggtttcaccgtgttagccagggtggtctcgaactcctgacctcgtgatccacctggcttggcctctctctcaaagtgctgggattacaggcgtgagccaccgcgcccggctgcatctagtttattttcatctggcacggcaggctgttgaggttttacatcttgagcaagaataacagccaccatccaatgggcacatactctgaggtaggcactatgctgcttgctgttcatttgctctgtctcatttaatcctcacccaacaacccattgaaggccatattattaacccagttattttgtttgtttgtttgtttgtttttgttctgagacagccttactctgtcacccaggctggagtgcaatggcgcgatctcagctcactgcaacctccgcctcccaggttcaagcgattctcctgcctcaacctcccgcatagttgggactacaggcgtgtgccaccacacccggctatttttttatatttttagtagagacgggatttcaccatgtttgccaggctggtcttgaactgttgaactcgtgatctgcccgcctcggcctcccaaagtgctgggattacaggtgtgagccactgcgcctggccttttcccagttttataggaaactttggctcagaggtgttaaatcacctgtccaagatcacagagccagtgagtagaagatctgggagttgaaccaacacagactccaggcaccacatttgtaacccgtgtgctaaattagatgcaggtacaaggaggtcagacactttagctgattggctaaagaatctggttgatgctaccaacctaatttgtgtgcatatgagggaggcctgtggctcaacacacacattctttggagagaggatcatctacaagattaatgaattcaagtaattattcattccatttccatctttcccatcactgctttgttcctgctctgtcccctatacttgtcaccatgctggcatgaaggacatttccaagaaatccttgttggttgaatgagtcatagagaagaaaagaaaagtgaaaggaagaaggaccagggagggaaaggggatgggtggaaggaaggaaagcgctaaaggggcaagagtgaaagaagaaacaggaagaggctaggagatggatgggtggaggagcgacctccccagcctctcctccacagactgcctcaaatgtacccgtgagaatccccaggtttcccagtatcctcctcccccaataaaatatcctgccttcagccttcacttcaggagcttctcccaaagagctaagggccggctgaagcccacccctacccctgcctgaccccttgccctgcacacccttaagtgggctctgggctctgccctattctcagagccttcctcagcttcctggcctggcctcagagctcagtgctaccttcctgccccacttcctcttcctgcctccaagttccctggagataaggccatccaggcattgacccctagccaggccacatccatcacacctctgtcagtttctccaaggcaaaatcttaaagcaccaagcctacttcctgcccagtccattttcccaggagccctagggaaagggagaaactggcaccagctgttcctgacatctttgccttggagatggcaagtgaggacaaaggccaggatctgcagcaggagtggggatgactcaactcaggaatgtgtcactaggtagaggttagcagggagtcaggcctgtgccatacactgataacttcagtggaactttcagagtaaacatctccctttctctttctctaggggaggagttcgccctccaacaccctgccatggggctggaatggcctctgccaccccatctgctcaagtttccaactcctgagccaggcttggctcctcacagctgcggaaagggctgacgaggtcgttacatttcctaccacttcttagcagtgggttctgagtgccaggcgggtctctgccactgtggctcctttaacctcgcaaggacccaacaaggcaggtattactgaccccacttcacagacgcggaaaaggaggctcagggaggttaagtgacttgtcccgggtcacagagctgggatcccagcccggagtccgactccaaagtcggtgctcttaaccgctttgcttcaggagaatggggagcccgagtcccgctcgctctgcgcggtgcagccaggacggggctcacgcatttctctcccatgcggcgcgcagggagtggagggtccgccccgtcctgctccagcagtggtcaccgcctcaggtctggccctcgtgggccccaggggaggccccagcccgcggactttggactcctctctcccaccctcgccactcgccctctgcccgtcgcagggctggccggccccgcctgggccctcaccatcgctgctgccgccgccgcctcgcccgctcccggcttctctgcctgcggagcggccgcagtgccagcggccccggaggaagagcaggggcggggcggggcgggccgccgagcgagggcggggggcgcgccttccgcgagtggcgacagaaaccaagtcaaatcgaaagcgatgggccacagcgacctgggtccgtagagtcggaccctcccgggccccaggagcctgaattcggatgacacctctgcctggtgaacgggcacacctcggggccggatctgtggaatgggcacagtggagtgagccctggagtcttctagctcgagttcagctgaaaaggcatcattcattcactcaacaaacaccctatgagtgccacggtcaggcaccatactaggtcctggagacgccatgaacaagccaggcagggtctttatcaccctggtgagtgcatctcacccagaaccaaaaacaggcacccaaaaagttttgaaactaaagacaagtggtggttgcacaacattctgaatacatgtcactgatctgtacactttaaaataacaaactgtacattgtgtgactttcacctctattcaaaaagaaagcagccccacatgggcaaagtactagctctagcctttctgtatgtctttcctcaccatgagggcaagtgcagctctgtgctgtcatgcacccgccatgcacttgctcctcagtcagaggatgggggaggctggtgtatctactaccacttcagagccttcctgagccgaatctacccatcctgtcctctcactgctacagagaaaccaccagctacctgttctccactactccaagctgcctcggacatcttaaaataaggtccctcgtttttttttttttgtttgtttgttttttttttttgagagagacagggtctcactatgttgaccaggctggtctcgaactcctggcctcaagcagttcttctgcctcaggtttccaaagtgttgggattacaggtgtgagccactgggcctggtccctcaagtgaggcctctcttgaccaacagaattgaaagtttccctctctggggct

SEQ ID NO: 255 - DNA, 2927 bp, Homo sapien
tagaaatcagggctgttggaggcagaaggtatgagtttgagggttcaaggtgttggctggaatcgggggttatagagaccaaagagattatacaggaccaagaagtaaaggaagcctgggcaaaataactctatcccccaacccccagcacatcatgatagcatcaatacacacctacttgtgatcaagtcctgtttatttcagaagcttgaacagtagaactaggaaggagtgatgaaaacaaggcaccagtccccttgacagggccaaatccggcacaagctctgtctgtgcgatcaaggctgacccagcagcctcaatccgccttttcctgtgaggagagggtttgaggacaacctgcgcacaggtgactgttccatagggtgaggttggggtaagttggctctgggttcctctggatcagctgcaaaaggccagagggcccccagtacccttggccaagagcattccatgctgactctgtctgtgctcaggcaaagccacattctggagaggaagccgtagtgcctggtgggcaccaggaaggcctcaggtgttcaagaacaacttgcaatgaggctccatggccagcaagcatctgcttccccagcccagtcatctctgcagagccttccaggagggggcagggggcatcccaggcagccagacttctcaggacccctctgttgggtgacataagccacaggcctctatacatactgcttcttagaagcagagctgctgggacgacttgggggtttttggccattctgagggggtgggtccaggaagagagggggcctggaagacgccagcctctcctctgtggtcaggttggcccagttctgctcactggatgagagcccattgtaggtggggcatggtggggatgagggcccctggcccacggggaggtagaagaagacctggtccgtgtaagggtctgaggaggtgccctgggtcgggggtgcgtcttggccttgccgtgccctcatcccccggctgaggcagcgacacagcaggtgcaccaactccagcaggttaagcaccagggagatgagtccaaccaccaacatgaagatgatgaagatggtcttctccgtggggcgagagacaaagcagtccacgaggtaggggcagggtgctcgctggcacacaaacacgggctccatggtccagccgtacaggcgccactggccatagaggaagcctgcctctagcacactcttgcagagcacactggcgacataggtgcccatcagtgctccgcggatgcgcaggcgaccatcttctgccaccgagatcttggccatctgacgctctacggccgccagcgcccgctccacctgtgggtccttggccggcagtgcccgcagctccccctccttctgccgcagccgctcttctcgccgagacaggtaaatgacatggcccaggtagaccagggtgggtgtgctgacgaagaggaactgcagcacccagtagcggatgtgggagatggggaaggcctggtcatagcagacgttggtgcagcctggctgggccgtgttacactcgaaatctgattgctcgtcaccccacactgactcgccggccaggcccaggatgaggatgcggaagatgaagagcaccgtcagccagatcttacccaccacggtcgagtgctcctggacctggtccagcaacttctccaggaagccccagtcacccatggctcccgggcctccgtctgcaaggagacagagcacgtcagtgtgtcagcatggcatccttctcgttcgcccagcaacaagcctgcagggaggtctgccacgcccgttctacctacaaagaaacccaggctcaggaaggggaaggactggcctggaggctcccactcagcagtgcaggcaggacccaacccagatttttggatgatggctgcccacctctttgtatggtctcattctgctttggctaaggtccctgcctaatcagacatctatgtccctcttgtccccgagccactgccccaggatggacacaggccaaggaaatctgggtggagttgaggctcctttgcctatgggaacagaatttgaggaacttatccaaagttgtgcagctgggctaagcccttcctcccttttgcccaaggctggctacccccagacagtgggagctagtgatgatggtagaggtgttatcttctgcttcttagggggctcaaagcctcaggtccctgctccccgcctcatatcttacccagctggcttcactctaatctttgagcctgcaggggctgggtagtggaaggggttttaggagctgaaggcagcatcatcctttagctccaccggtcagcaataatgaccacctgccacttgaggagggacatttggtcctgtcttcttcctccacctccactcccacccccttccacctccaaagctgatgctggcaaattctagactcttgaaaggaattgtcattgcagggtgaggcacaggccacaaagttcccaagggggaggtgcctcttcccaagtgcaaagctgtttagagccaggctctggaagcggccctgggttcaaatcttgccttttagtaactgcggccccttggataaggaacaacctctgggcccctcagtctcctccacgatagagtggaaacaatagtattcctcccgcctcgggttgttacaaggattccatggaaagagggtgggagcctggccaaggccacctgggtgagcgcggctctgtcgcggcgggcgttccgcagcaacccccgtcccggcatcggaggacccaagactcctcccggcctcccgcgagcaggtggcgcccctggtcccttcctagcccccgactcaccgcctgcctgccgggcggcccaggtggaggtggggacgatggccggagtgacgcccgcgggagccctgct

SEQ ID NO: 256 - DNA, 10000 bp, Homo sapien
cgggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccaggtgagctgcggccgggactcctgggagctgtccggggtcgagggctgagccgcggggaccccccgagctctgcggggacgggcaggggacagacgcgcggcctgggcccgactcctcctgggctctggcgagggcgtctcggtggaagctcccaggaggcgcaggcgctggcgacaacaccccagctgccggactttggggcgccgggggctgcggtcggatcgtcctggggtccccgctagctagctgcggtgtgcgcttctgtggccggggataggtgaattgggcacggggcccttcttagctcctttgctatcagagtaactcgcacctcttttgcagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggtgagccccgcgggcgcgcgcggacgttttagctgagaaagaggaaaataccttagtcacagaataaagtccagaaacgcgctctaggattgggtcctgccgtcacttttccttggtgcttctcccattcgttactaagttgacatagttgtgtttttttgttttgtaagtataaatttgatgctagtttgtatgtttaagtggttttaaaaatcaagccaattaaaaaaatcgatttgctaatgttgcggtaaagaaagatgtagatgatcttcatatgtcactggctgcaggcaggcgtctgaagacactgtgcgcccccgggtgcctccacagtgggcatccctggccactggggacacagagaatgaaggaaggaagccatacacttgcctcttggctccttgtggcaataggaaaatgggacagaaagtcttcctgcctggaattcgagaacgtttcctcttatattgctgtcctgtttggtggtggtaataaccctgtccctgtataacaggtatagttgctgacagtgccccatcagcctctgacatgtgtcccactagaggcctgagaaggggggtcatttcccgtgtggtcatttcccagaccacacgggattcaggcctcaccctgtcctcccaaccccatcccggcctcaccctgtcctcccaaccccatcccctaccttgttcctcccgcctaaggcattccaagcctttgttcaccttggtacttcttacacacttggaagtttacaatgggaaagttctccccttcctcaagcttgtgtgatttccatcattcaggcatcaggtgaaatgtcacctctgaggaagccttgcatgaaaacttgtatttccaaccccacagcttcaggggtgagttgtgggtttgtctcccactaggctgagctccccaaaggcaaagactgtcttgttactaatcacgtgtgtagggccagggatggtgtctggcatagggggtgtgatcaatacctagcattctggcaagggtcagtagaaacatgggctggagccatggatttgcaatctcttgagaacagtggttctcacaggagggtcatctaaccttccaggattcatttgaatttccatgtcacaatataggacaggggcatgcgctgtcatcgcggaggagaggtcagggtgggcatcctaccaggctcagggcagcccccacaatacagaagcatctggcccaagatgtcaacagtgccaaagctcagaaacacccatctatagtcgtcctcctgccaaacaaattctcagttgtaagggatagtctttcctttgctctgatgtcctgttaccttaaaatcaaattattttattggggttaaggaagcttttcactttccatagatacctttctcttgaaaaggaaaaatataaacatttcatctccagtggcagtccttttgcttttttatacagtactccttgaatatatcttcatgcaagattttataatttagaaataattcctaagtgtttggtcacatgacctgggtaggaagagagattcttagactccaaaggttcagatggagaacagacaggccattgcatagtttattcaaatttttaagatcacaggctagaacaggaacactgaagactccaagaacctactaacaaactcttctgattattagtttgtataggtttaggaattgtctcttctgctactttgccatggtgttagctttctgtggaaaaacaagttgaatttagattttttttttgtgtcgcttgcaaattagtatttttattgtttagagacttgaatctgtcagtaaattcagtgtagttttaaaacaacaatgaaaagcttacccataatgagcatttactatgtgctaggcaaattagtgacatgtacaaccatttaattgaacatcacatgatgtaggttctaatgtaatttctttattgtatatgaagaaactgatgcacagaagtgctagcatcaaataagcacatttggggatgattaaacctctaaacatatttaacattacaaacaaacgtttttgaaaaagcacagagtattaaaaatagtcattatccaaaattgatgtaagtattcctttgtgtcttttaagtatagcttttcatataaaaggtaattcgatttgtgttctagtgttttcccttgtttttatatactctctgttttaaagatctaatagttacatgtttaatacttccaaaagttctttgcaaaatgcaagatcgtttacattgcccattttgtttgttactcctttatgtcatatttacagatcaaacattctagtcaaattgtgttttattttgggaaattgaggtaatcttttaaaaagttgcagcaaccaaaaaaaccttcttcttttgcatgaaggggtattgaatgtgacatccgtatccagcttcctgttgtgtcaaaacaacattgcaaaattgaaatccatgagcaggaggtgagtgggttttttgaagatctacttttaaagctttttagttcacttttaatctgttcattagttacatatttccccttcttttcacttgcaggcaatattacataatttcagttccacaaatccaacacaagtaaatgggtctgttattgatgagcctgtacggctaaaacatggagatgtaataactattattgatcgttccttcaggtaggtaaaagctgattggtctaacagtaaatgtcatcttctgattaaccataaactagtgtcaaagtcaactgtcattcttctttaatgttcatggatgtcaaagtatttcaggttttcattctcaacactaatcttaatttaaaaggatatggatctaggaagatgactaattgggacaaaatgtgatggaattcaaggatttgggtgcaaataattatgcagagggaggttgaccttgtcctaaaggagtttgttattttcttccaagtgttttgaaactgcatgagatttttctattcttttttattttaaagcaaaatatacacagagaaaaaggtacaaaacaagatggacaggtcaatttatcatgtgaacacccttttgatcaccacctattatggactgatttgtgctctcccgaaattcatattttgaattcctaacccctcgtaccttaggatgtaactgtatttggaaagagggcatttaaaaaggcaatgaaggctttttgagctattagtatgggccctaatctgatgattggtgtcattataagtggagattagggaacacgtgcacagaggaaagcccatgagaagaggcagcaagaaggcagccatcttcaagtcaaggagagaggcacagagaaatccaatccagctgacaccttgctcttggacttccagcctccagcactgagaagggcatgtctgtttttcaaggcattcagtctgtgggactttattatggtggccctagcagactaatacatcctcagctcatatagaacatttccagaagctttttaaaaatgctgttgtctaatcactacttcattccctcagcaagtaaaccaccgttttggcttttaggatatcataaacgtctcgagtttcactatctaagcatggatctctgaacacgatagttttgtctgttcttataaaagtccttaacagtgatacaagaatgtatacatttgtgcctggcttgtgcttttctgtgtgtgagattcatagcatgttggacatctctgtagtttgttccttctcatggcataagtatttcactgaaaaaaaaatgtttaatatatacaataatatacataactatacagaattcattcattcttgatggacatttgactaatgtctagtctttgaaatgtgtcaaggtttgctttatgagcagatatggctaattatcttactaatctgccttgtgtaattgaaaactgtattctacagtgtctcatatatatgtaatatataattatatattatatatatcacttatataatatataattataatatattatatataatcatatataattataatatattataatatataatattatatagtatatactatatgttatatagtaatatataatataataatatatattatatataccatatagtatatactgtatacagtatatactatatggtatatataatacatatacaatatatatacaatatatttatattatataatatataatatatacatatataatatgtaatatatatacacatatacagatacacacactcccgttagattcaaatctataatcttagtaaattttcccctactattattctaagagatatgttcaaatcacctactgaggattgattgattgatttgtttttatctctatcagtttttgctttgtatattttgaggctgtactatggtgtacaaacttagaatgatgtcttggtgcatggaactctgtcatttagagatgtcctctgtttttagtagtgctttcttttctgcttaatgtttcctttggatgatgagtatggttaaactaatttccttttgatgagtgcttgtgtagtataacttttccacccccttaattttaacttttcataattgttatggtttaagttgtctcttggaacctgttgtcaggtgacctcttgtgtttaactggaatatcttcttgctggattgatccttatataaaatgtcctttttctctatgaataacttttgtctgagatgattttgtctcatgttagtacagtactccagttcccctctgcttgctgtttgcatggtatatcttttcccatgcttttattttaaaagattgtgtctttgaatcaaaattgtgtctcttgtagacaacgtattagttgggtcatttaaaaatccattctgctaaatgaatctctgttattgtcttcatttgtattagctgttttttaatgcaccacttaaattccctagtcatttcttttactgtgcttctgggaagtttgccttcatttttaaagagtatttttattgaatacagacttctatgtaggaagtttttctttttttctttttctttttgtttgtttgtttgtttgtttttgagacagagtcttgctctgtcacccaggctggagtgcagtggtgtgatcttggctcactgcaacctccgcctcccgggttcaagtgattctcatgcctcagcctaccaagtagctgggattacaggcacgcgccacaacacccggctaatttttgcaatttttagtagagacggcgtttcaccatgatggccaggctggtcttgaactcttggtctcaagtgatccacctgcttcagcctcccaaaatgctgagattacaggcatgagccactgcgcccggcctataggtaggaagcttttgatgtttattggagggctgaactatttttcaaaacaagatattatccaaattgagataaattcagatgattaaagacatccaacaaagatttgaaagtgaatcttagaaagagagacttgattccaaactctctaccatgagaaataatatcagatgtgtgactgcttcagatcttacttaggttgcctataaattcaaatcaggtcatttcactgaggccaaaagttttcattatgcaaaataaaggattgcttctatgacttgatcactgaggtttgccaggacaattatgtatcttgctaaaggtgatcttcttaagatgtacctgtcttgttcagatacagactgaatgtgtgggaaactgaagtgatcatagtgttctaaaatataggtttgtagttaccctgtagtgtaagtgtagctttttatttaccctgaagtatgtaacttcacaacgtgagaaagattcagttacctacaggcttcctggctggccttccaagccatccgatgatttccatggacttaaactagaagaaacttgactttgctctcatgtgcattagcttatgtcatagaaggtgcttggtaatattgtcaaatcatacctgggctgttcgtcagtgatcagaagttaatctgggtccccagcctctgacagtggtatttcaaaacaaactcgatgcaactaatcctagtttttagtgtaaaagcacttttctaactctaaatttatttctttgtataaggtgatgtcttgaactaaacccaaagtttgttcgttgatccttggacattaagtggatatggagacttccgccccagggtataaatttttaatcaggatctttgtcgttctataaactgcaggtatgaaaatgaaagtcttcagagtggaaggaagtcaactgaatttccaagaaaaatacgtgaacaggtgatagaaaatatccaagtttgggctgattcgtttcgatgatatgaaatcatttatgtatgctttaatgatttcttacttgaaatcagttacaaagagggtggttactgttatagtaggaaaatgtaactaaagtataaaaacgagttgaacttagacgtattaaaataatctaaaatgatatttcctctttattgttcaaaatcagagcactaagttggtcttacacttttagccaaaaagtctattagagcatgttgcgagctttttgcaaacccatgattaggataaccccaacacgtagagctaacatttgggaattgcattatctggtggctcattttgtcgcccagtcattgtactcatccgtctttatgtgtctgaaataatcacattatgaaaatcatgagtgccaaagatgcttctctattttgatagatagacgacccatgaaacaggaaaagggatcctgtgctttgtcttgtgagagaatcctatagtttgagtgtatcagtgtggaacaggtattccaattgtacagcttatgaaaacataattgtcgacacgtgcttcgcaatttagatagtttgagtatatcagtgtggaagaggtattttagttgtacagcttattaaaacacagttgtcggcatgtgcttggaaatttagtgggatttaggcttaggatgagccctgagaattcatatttttcctacattttagagtgctcctaaagctagtttcagatgagctccttggaatatcttggcttaggagagttatcttaggtgcacctgaaattagcagtaggtactcttgaatttcaacatttctgcctttttttttttttttttttctgagacggagtctcactccgtcacccaggctggagtgcagtggtgcgatcttggctcactgcaacctccgcctcctgggttcaagcaattctcctgcctcagcctcccgagtagctgggactacaggtgcacaccaccatgcctggctaatttttgtatttttagtagagacagggtttcaccatattgaccaggctggtcttgaactcctaacctcgtgatccacccacctgggcctcccaaagtgctgggattacaggcttgagccaccatgcccagtccatttctgccatttaagtactgccttcttccctagaggagcagccttaatgttgaatctgatggtcatcagttcccgtgctggaagccagtttctgaggcatcccacactgtagccaccaggcaacttgctagtctatgggagtaaataaaccaaaaagccagttgaactgtgggttagatatgtgccactcagcagtctaggaactgtttgttctgttactggtctgtgatatagtgagtactgaaatggagtatgtagtaaatatgacagcaattcgacagcaattttgtggctattgaatgtaatcgtacaacaaaagtgagattatatactttacatattcataattttattagtggttcatttatattgtttagtcataagattcttgttccacttcagattggaaataaaaaaccatccctcacatagatagttttagaagcaaggtgttacgtatcaagaaacctaaaattgattaaggaagttagattctttgcctttgttaatattttttagatattttcttaataatccagatgataagcttttcttcctttggggcatcagacttttataaaagttatatatatatgttattctttagttcttccacccttccggaaataattccatatgaaggaaagttagggcgctgtctctggggagccaggtgggggcgctgcgcctgctcccaggctgtgaggttgcagaatctgtgaatataccatgtgtgcctgtaccatgaatttacctagggtgaatctaggctctcagatccaccctaagtatccaccagccaagagggcgcacatgccaagtggagcctcagttcatcgacaggtcctatggcccatttgtgagaaaactgatgacgcagtcagtagttctgagctcgtggggggttacagatcttcagtataggtgatgtttaatattgactttggttcttccgcaataggatgttgggaaatatctttaaaggaagttataaaaacacaccgaggtttgattttagtaattttaagcctcgaatttgtttcctattaatcactcactattttttaatgagtcagctaataagtacttttatcctgaccactagctcccaactgacttgagctcatttctcaaacagtctttaaaagtcatatacgagtggtttggtaaagaaaacaattttttattgtttttatttttattttttgagacagagtctcgctttattgcccaggctagagtgcagtggtgcaatctctgctcactgcaacctctgcctcccgggttccagcaattctcctgcctcggccacctgagtagctgggactacaggcacctgccaccacatccagctaatgtttgtatttgcagtagagatgaggttacatcatgttggccaggctgttctcaaactcctgacctcaagtgatccgcccaccttggcctcccaaagtgctgggattacaggcatgagccatcatgcccagccagaaaacaataaataatattttcactgttgtgactgtcatcatttagaaagacctgcaaataactgttcttattttcccaacttacaggagccagcacgtcgtgtctcaagatctagcttctcttctgaccctggtgagtagtggttgggttttgttccagaatcctgaaagatcaggtctttgcgaagcatattggcaaagaaggggcaacaagaatgcaagtgctaa

SEQ ID NO: 257 - DNA, 6434 bp, Homo sapien
ttcaattatatagttttagagaacctttcttgcccaacacttttctgatagcaagttggacatccttgtttctgaggctataaaccatggggtttagtaatggagtgacaatcgtgtatgtcaccgtcaccagcctgtctttgttggacacatagtttgctgtaggcctcaggtagatgaaggaagcacagccataatgaacaataacaacactgaggtgagaggcgcaggtggaaaacgctttccgtctgccctcagctgagggaatcttcaggatagtcctcagaatgcagagataagaaacacagataaacagaaagggaaccacaagtacaagaactccacaaatgaatatcacaaattcgttaacatctgtgttggtacaagccagaagaatgactgctgagatgtcacagaagtaatgattgactttgttggcgctacaaaaagggaggctgaaaactaaatttactactgtaagagaggccaagaagccaccaattgcacaggcagctgccagttttccacacacctgccagctcataagagtggggtaatgcagagggtgacaaatggcagcatagcgatcataacccatcacacccaatagcaggcagttggtaatggcaaaaccaaggaagaagaacatttgaagagcacaacagttgaaggagattgtcctggccacagaaagtagattgatgagcatcttgggtagaatgacaaaggtgtagaaggtctcagatgttgagagaatgccaaggaagaagtacattggtgtgtggaggcttttatccaggtggatgacactgataatggtgacattgccactaagaatgactagatacagaaaaagaaaaactacaaagagggccagctgaatttcaccaaggctggaaaaacccagcaacaggaattcggtgaccatggtgaggttttctgccaagatctgcaaagggggaaagaagtaaaacatattcaggtatgtgaatataagaatttggggcatgcactcctttgttcctttcaggtggtgacaaagaagaatcttgccttttattcaccttttccggttcctaactacctctcatgttcattggttcatggtcctcttcttccatcttcaaagtcaacaaagttacatctctttctctgactttctgattctctctcccaattttaagaacccttatgattactttgggcccaccagaataatacaagataatatctctattttattgtcagttgactttccttctgcagccttaattccttgagcttgtataatctaacatattctcaggttctggtgattaaaacatagacatctttgggagctcattatttggcctactacaacaagcaacaaaaaatctaaaaatgatattaagaaaacaattcaattcacaatatcataaaaaagcttagtgtcagatttaacaaaaaagtgtgagacatatacagagaaatctctcaaacattgctgggttaaattataaaatatatgactaaatgaagaacacccatgttcatgagtttaaagatgtaataaaataaagagcaattctgaccaaattggtctatgtagtcaacataattcttaacaaatcccagcaggcttttcatctaaaggttgataagatgattataaaatttatatgaaaagaaatcagaattgcccaaatgtgtctagtttaatcactaaatagaggcttttggagcattgtgatccatttaattgtcaccattttagtcctactctaggatctttaagtgtttctggaacacatcacagctctttgaagattgttgatagaaacaattgtaagttgattatttgcattctcaggctgataaagtttaccactctagtaatgcccagttatatttgtaataataattaaaataaccataaacacattttacaaaagaagatattatatacctgaacagagggttgggagataggttctgttgagctcaatatagatggattgaattaggttaatatcacttattccccactttgaacagcaataatgtagacattcaagaaaaatgagcaaacagattatgactaattatctgtatttatatgcagaataagtattttctgaagtgactagaattatccttatcaccttccttctttccttacccatcatcttcatctatagacacacatggagtccagcatgccttaaataaaacatggtccattgtagagtcattgaattctgatacataaactgcttttaggaaaaactttgtgtatggtttatgaaaaaatgaaaattggggtttgaaacttacaatagtttttttctgcagtaaatagtcaaagcaatgtagtatacctttgattttctagtaacagttaattaaatcttagtataagagaagacaagaatactttttagtcaggtagaatcccattaaataaaattagcttatatgaaattttttctaattactgcacataaacctcccctcaggttctaacaggtagaaataagaatctcttctctctgtcaatagtttcttttgctgtgcaaaagctctagtttaattagctcccacttatgaatttttgtttttgctacaattgcttttgggaacttaaccaaaaattctttgccaaggctgatattgagaatagtattccccaggttttcgtctaggatttttagagtttgaggttttacatttaaatttttaatccactttgagttaatttttgtatatggtgaaaagtgagggtccagtttccctcttctgcagatggctagccagctattcccacaccatttattgaatagggcgtccttgttccattgtttgctcttgtcagccttgttgaagatcagatggttgtaggtgtgcagcttgctttcttagttttttattatgttcctttggtctatgtgtctgtatttgcaccagaaccatgctgtttgggttactgtaacgttatagtatagtttgaagttggctagtatgatgcttctctctggctttgttctttttctttagggttacttgggctatttgagggcttttttggtttcatatgaattttataatagttttgctaattctgataaaattacattggtagtttgataggaatagcattgaatctgtaaattgcttttgacagtacggccattttaacaatattgattattccagttcatgagtatggaatgtttttccatttatttgtgttatctctgatttctttgagcagtgttttttagttctccttgtagagacctttctcctcttttattaggtgcatttctagatattttattttctttgtggttattcaaatataattgtgttcttgatttgaccctcagtctagacattattgatatatagaaacactactgacttttttagattgattttgtatcctaaaattttgctaaagtcatttatcagttctaggagccttttggcagagtctttaaattagttttctagatatggaataatatcaacaatggagacaaatagtttgacattttcttcctatttggatgcctttaatttctttctcttgccttgaataggagtggtaagaatgggtatccttgtgttgtttcagttctcaagaatagttccagcttttgcttgttgaatatgatgttggctgtggatttgtcacagatggctcttattattttgagatatgttccttaaagcctagtctgttgagggtttttatcatgaagggacgttagattttattgaaaattttctgcatctattgagatgatcatatgaatttcatttctaattgtttatgtcatgaattacatttattgattttcaaatattgaaccagacaacctacagaatgggagaaaatattcaaactatgcatcagacaaaggcctaatattcagaatctttaagaaacttaaacaaatcaagcaaaaaacaataaaccccattttaaaatgtgcaaaggatatgaacagacgcctctcaaaataagacatacaagcagccatgaaacttatgaaaaatgctcatcatcaataatcatcagagaaatgcaaatcgaaaccacaatgagataccatttcacaccagtcagaatgctatgaaataaaagacttgtatctacacattgaaatgatccatcaccctttcatcttattcatattcatgactatccaagtgctcacaaacattgatcaaaaactgtaaagactaaaacgtatcttacacatttatcctatatacttaaagaagcattaattaaaacattaattttttaagtttaattattttaatttttttcctttttttttttttttttgagatggagtctcactctgtcgcccaggctggagtgcagtggcatgatctcggctcactgcaagctccgcctcccgggttcaagcaattctcctgcctcagcctcctgagtagctgggactacaggcacctgccaccacgcccagctaatttttttgtacttttagtagagacggggtttcaccgccttagccaggatgatctcgatctcctgacctcgtgatctgcccacctcggactcccaaagtgctggggttacaggcatgaaccactgcgcccagcctacttaaattttttttaaaaaatatagaaaacctgtctgtacatttgagcaaaaccattgatcagtaacaataaaatcatacgaaaatcatatttttgaaagctcttccatatgataatttgaaaatactattaaacaagtgttgggtcaaagggaaaatataatgtaaaataaaataagttctagaaaataatgtcagctatatatattagaaaatatggctaaatttaaagcagttatcagaagaaagtttataccttaattctttacctaaacaaaaatttaatgatttttaaaatataaaacatctcaatgccacctaaactgtttctgacctataatagtaacttaataaatacatctttaatacattttaaatatcagtttaaattttcaacggatacattcaaaatttatatgttaataaaatacaaaaaaatgtaaaggattagaaaacattgtattactggacagaaaatttgaaaagctaaacgtaaacaataatgagatattatcaaagagtattaagcaacaattggtgtaaaataaaatatttatttacagaaaggcacaattagaaataatagaaagcaaacaacaaatggaaaactaccaaaaatattcttcagatgttaatattaataaaaaatgtattacaagccgatggagaaaataacaaactttgaagaagaaaacagataaaagcatacagtttataaaatagaaatagaatgcatcaaacatataaaaatttatgttaaaaatatattttaacttgaagtgtatttcaaataaagtaaagtagagatattatttacactcatcaaattagctgtggtggtgttatatgactagtaacaaaaaatttactaataagattataatttggttttgtttatgccaagaaatttagcaaactatatctacatccttgaatatatttatctaatttattccaatattctatttcttaaaagttgcctatagagatttatatgtaaaaatgtatttttaatagggaaaaattgaaaattgtaacacaaactaatagtacttgttttaagaaaggcaggattattgtgtattgaatgacagtatggaatctagaggaaggtaacttggctttgggtaccagttcttccattgggtgactgtaaccttagacaatttatttaacctcgctatattgtagttgtctcatctatgaaacaggctgtgattattattaaatgtattaatttatatagagtgctgagaacaacacctgctacataataagtgctctatctagtggtattattttcttaactattattaatttttttttgctggtctctttgtcttataggaaaatacgttttaagacagtgattttgaaactttatgtttattacatcactgaggttatagaatcaaattaggtttcaaccccagcagtttttaaatttaaatggagagcagataaaagaagagaagattaaaataaagcatacccagtctgaatagctcttatttaaagcaaatattttatttcaatttgtgtatgtgtgcatgcatactaggtgtcaattaaaatatatttgtactttttcttgcagatagaactacaaaaatagaatacacactcaatgggctgaccaactgattcataacatctttattggagaatgaactttctttttctctccaggccccctgtaacccctgtctggtattttctacatgactgattcctctctagagccagaactatggaatcttaagagaatctgtatttctttaaaaagaataaatatcttatgacactctttat

SEQ ID NO: 258 - DNA, 10000 bp, Homo sapien
  misc_feature 5560, 5561, 5562, 5563, 5564, 5565, 5566, 5567, 5568, 5569,5570, 5571, 5572, 5573, 5574, 5575, 5576, 5577, 5578, 5579,5580, 5581, 5582, 5583, 5584, 5585, 5586, 5587, 5588, 5589,5590, 5591, 5592, 5593, 5594, 5595, 5596, 5597, 5598: n = A,T,C or G
  misc_feature 5599, 5600, 5601, 5602, 5603, 5604, 5605, 5606, 5607, 5608,5609, 5610, 5611, 5612, 5613, 5614, 5615, 5616, 5617, 5618,5619, 5620, 5621, 5622, 5623, 5624, 5625, 5626, 5627, 5628,5629, 5630, 5631, 5632, 5633, 5634, 5635, 5636, 5637: n = A,T,C or G
  misc_feature 5638, 5639, 5640, 5641, 5642, 5643, 5644, 5645, 5646, 5647,5648, 5649, 5650, 5651, 5652, 5653, 5654, 5655, 5656, 5657,5658, 5659, 5660, 5661, 5662, 5663, 5664, 5665, 5666, 5667,5668, 5669, 5670, 5671, 5672, 5673, 5674, 5675, 5676: n = A,T,C or G
  misc_feature 5677, 5678, 5679, 5680, 5681, 5682, 5683, 5684, 5685, 5686,5687, 5688, 5689, 5690, 5691, 5692, 5693, 5694, 5695, 5696,5697, 5698, 5699, 5700, 5701, 5702, 5703, 5704, 5705, 5706,5707, 5708, 5709, 5710, 5711, 5712, 5713, 5714, 5715: n = A,T,C or G
  misc_feature 5716, 5717, 5718, 5719, 5720, 5721, 5722, 5723, 5724, 5725,5726, 5727, 5728, 5729, 5730, 5731, 5732, 5733, 5734, 5735,5736, 5737, 5738, 5739, 5740, 5741, 5742, 5743, 5744, 5745,5746, 5747, 5748, 5749, 5750, 5751, 5752, 5753, 5754: n = A,T,C or G
  misc_feature 5755, 5756, 5757, 5758, 5759, 5760, 5761, 5762, 5763, 5764,5765, 5766, 5767, 5768, 5769, 5770, 5771, 5772, 5773, 5774,5775, 5776, 5777, 5778, 5779, 5780, 5781, 5782, 5783, 5784,5785, 5786, 5787, 5788, 5789, 5790, 5791, 5792, 5793: n = A,T,C or G
tgtgacggagtctcactctgtcgcccaggctggggtgcagtggtacgatctcggctcactgcaacctctgcctcccgggttcaagtgattctcctgcctcggcctcccgagtagctgggattacagccgcatgccaccactcccggctaattttttgtatttttagtagagatggggtttcaccatgttggccatgtttacaagataatacaaacaaaaccagaaatgttctgttatactaaaagtgatgtcatctgcaaccatttatctaagcaagaagagttatatcaaagttttcttcattcacatttttattacacttctgaatatttgtataagtgagtaaatggctgaaccacattccaagccacaatcttaaatattttaaatactgatgaaacctggttgtgatgagcaaaaacaaaaacattctgtatacacatacccccacatactcttaagatgttaaacagtaccgtgttccctccccgtctaaccatattccaaaacgttgcctgtcaatctaaccatatcccaaaacaatgcctgaattgtagctgacatatataattccatttcagtgtcatattattaatcccatagtgaaagaaatgtttctaaaacatgaaattctttcttacgagaaagcatgaaataggtatgaaactatactgggttgaaattttagtcattttaaaggtcactgtttctgctttatggcactgggttaccttttccaatatttaagtctcaaatacacgtttaaaaagaactgttaggactagtcaggtcatacatgtcaaattatacaagatgtagtcccatgaaaacaccaaaatactttaggaaatggagcagtgatggcatatacaaaggtttatcacatctcaatactctacataaaataaataatgccaacacaccctggtttgatgtcttctgttttggaacatgcttgccctaaggttttatttactttttttttttttttttttttttttttgagacagagtctcactctgtcgcccaggctggagtgcagtggcgtgatctcggctcactgcaagctctgccttccgggttcatgccattctcctgcctcagcctcccgagtagctgggactacaggtatgcaccaccatacccggctcatttttttgtatttttagtagagatggggtttcaccgtgttagccaggatggtctcaatctcctgacctcgtgatctgcccgtctcggcctcccaaagtgctgggattataggcgtaagccaccgcgcccggccaaggttttattttttaattagcctatggcacttactttattttctaatttttttccaatcataacagtaaatgaagaacctttgtttaaaaaaattacctgatgattccaattattgttcatgtacaactttatttaaaatggcaatctgagttgtcttcctgacatactctgtaccaaatcttagtactcagtttcatcaagtcctttgccaattcatatattcaaaagaaacatgataaaatgtaaaaggagaatggagtgcgttaaggaataatcaataatttaagattatcaataattttgatattaatattaatttcttagctgtcctactttaatgattttcattgaaactctggcacatctttaatagtctcatgacattactatttaaataaacatgattttcatccaaattattttattcttcttttttgtttttcctttggagacagggtctcgttctgtcgcccaggctggagtgcagtggtgcgatcttggctctctggaacctccgcctcccaggttcaagcgatcctcccgcctcacccttccaattagctgggactacagatgcccaccaccagccccagctaacttttgtatttttagtagagacagggtttcaccaagctggtctcaaactcttgacctctggtgatccgcccacctcggcctcccaaagtgctgggattacaggtgtgagccactgtgcctggcctattttattcttatttataacggttttctcaatttgtagcttaaattgaaagtacttgcaaaatgagaataatttgtctctactacataaagaaataatttttctaccccaaatgaagataaagtcacttctcacaaaataaacattaatttagcagaattaagtttccccttatggcatctgatgcttgaggattaccaaggatccatgcaatagagcactacattttggaattagctgagaatgatcccaaatttcctctagtaaacataattttggccacaaatgaagacaaaagataaaagtaattaattctagaagaacacctctcgtcagaaattaatagatcttatttaggtttctaggaagcatttaactacataaaacttatagggaaaaatggccatatttgaaaactgctacaaggatcaatgtagagcacaggattgtaatgagcagagtcacagaacatactagagaggtatgtacagtcagtcccactggaacttgtagaatcacattcttatatacctatggagagagagagagaagttagacattgaaaatgcatgtcatgggcccggtgtggtagctcatgcctgtaatcccagcacttcgggaggccaaggcgggcagatcgcttgaggtcaggagttcaaaaccagcctggccaacatctctactaaaccatctctactaaaaatacaaaaattagccaggtgtggtggcaggtgcctgtagtcccagctactagggaggctaagacagaacaatcacttgaacccgggaggcggaggtttgcagtgagctgagatcgtgccactgtactccagcctgggagacagaggaagactctgtctcaaataaataaataaataaataaaaatagtaaaataaaataaatgtcataaggtgagaccactatttctttgatttttaattggatatttttatttcctttttcttttaaatatatttcagccagtgctacactacatgtaatattattggtttgaatgacttttgaatctaacatttcatttaatgttacagaatcagactcaattcccacaataatttgttaaatctcattagttctgatttttctgctttttacataaagtatattattttaagaaaagctatatcccagtgtcacctctgtaatcaatataaacatttacttcctcttaccatgtttcaaattagaatacagaattctctctaaattgaagacttagaggaaaaacattaaaacaacaaaaaactaaattattctttcattcccatttgcctttctctccccagatagcttttaaagccttgttattcccatattgtacagctggatgtggcctttactatgactagcaatggaaaagctcctacattcaactcagtttctattttctatttggttttgaagataaagttcaatgaaaaacactgggaaagtttatactttaaaaataagttttaaaaaacattaaaatgtacgtaacttgggaatactttttctttttgtaaatacctgaattatgatttcacaccccaaaaaatacaagtaaccaacccaatctgcaacaaagtgctatctgaaaaccgtcattcaaaaaaatgacatcttcaacaatccttgggatggaataccaccttagtaatggccacctatttttctggtatatatgaagatgaaatatatataaagttggccgggtgcagtggctcatgcctgtaatcccagcactttgggaggctgaggcaggcggatcatgaggtcaggagtttgagaccagcctggccaacacagtgaaaccctgtctctactaaaaatacaaaaattatccaggcatggtggcacgtgcctatagtcccagctactcaggaggctgaggcaggagaatgacttgaacccgggaggcggaggttgtggtgagccgagatcgtgccactgcactccagcctgggcaacagagcgagactccgtctcaaaaaaaaaaataaaataaaaaaaaaaataaaataaaataaaatatatatatatatatatatatatatatatatatatatataaataatatatacatatagttaaaagctatatttaaagtgttaaattattatgacctcttatggcaagttacagaattttaaaggcaactgaagtcaggtgtggtggctcacgcctgtaatcccagcactttgggaggctgacgggggtggatcacctgaagtcaggagtttgagaccagcctgaccaacaaggtgaaaccccgtctctactaaaaatacaaaaattagccgggcatggtggcaggcgcctatagtcccagctactcgggaggctgagacaggagaactgattgaacagggaggcggaggttgcagtgagccaagattgcaccactgcactccagcctgggcaacagagcgagactctgtctcaaaataaataaataaataaataaggacaactgaattcaaaatgttttaaaagggtcactacttatcttgtagcaatacacactaatttgctaaatcaataaatcataaacactaagcatactcttcattgacataatcaatcaaatgcaggtctccagatgtattttagagtttgagaaaaattttcaggtaccatatggcaatggcaacctactcaaaaacaactctacactgcataagattgcagagtcatccatcttcccaactgtatgttcaatgaaagttccccaacaaaaaacagcagtgctttgtagtaaccctttgctgtaagaaaaaacagctttctatattagaaaatgctaatcccagctgggcacggtggctcatgcctgtaatcccagcactctgggaggccaagataggcggatcacctaaagtcaggagtttgagaccagcctggccaacagggtgaaaccctgcctctaccaaaactacaaaaattagctgggtgtggtggcgggcacctagaatcccagctacttgggaggctgaggcaggagaatcacttgaacctggtaggcggaggctgcagtgagccgagattgtgccactgcactccagcctgggtgacagagcgagactccgcctaaaaaaaaaaaaaaatgctaatctcttaaatgtggcaggaacattacagaaagagctttaaatgaggcacatgatctaaaaaacaacataaaacattagcttactgatttatacttcatcttgttccattggcagatatcctcattctccaaagcacaaggggctgccacttctgagtgagcccagcatttcaaaatcgggaactctgagaaaagtggtagaaaatgatgtcagaaaacctgtatttggactgaaagctaggcttgtattaaacctcaatagacagaagttgtcaaacattttaatacattatgtatatgatctggacccatctatcacattctgttattttagcatccttttttatgtgaatgcctaagaaattagaaaatcacaaaagtattgcaaaagttgaacatgacttccttttttttttttttttttttttttgagacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctcaggagaggaactttttcaaactttatttatgctaagaggtacctttaatagaaacagaaaacaaggttggatgaacaaaggtaatataactgaacatttttaattttctcgtcatgaaaggtatgacggtaacaaatgtagtattaaaaacttcccatctgtcggtttttagtaacagcgctactaacttttttttttttttttgagacagtcttgctctgtctcccaggctggactgcagtggcgcgatctcagctcactgaaacctccgcctcccaggttcaagtgattcccgtgcctcagcctcccgagtagctgggattgcaggtgcataccaccacacctggctaatttttatatttttagtagagacagggtttcaccatgttgtctaggctggtttcgaactcctgacctcaactgatccgcctgcctcggcctcccaaagtgctgggattacaggtgtgatacactgcacctggccccagtgctactaacttttataaacattctaaatcaacccaaatttgaagacacaaagaaccaaaaactgaaaggggcttcgtaaactaaagaaaatgtgcttggccaggtgctgtggctcacgcctgtaatcccagcactttgggaggccgaggcgggtggatcacgaggtcaggagttcgagactagtactggccaacatagtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactcacagacaaaatctgcaacaaaactaggtgataaaatatcttcccaaacatcaaaatacatgcaagtagaaacaaaacatcaaaagccagagtcctgcaatactgataacaagaaacaaaaagcaacagaggggtaatgtggaccaatggctgcaaaaagaaacacatagtacatgcctactaatattaaatggctactgagaagagaacacagcactgacctatagttttgtcaaaggaatcaaaccggaatctgatcattcttctggagccagctgccaatttccagtaaataaagaagtatgaggaacatgagtccaattagcaaaaccccagctatgaccaactacaggtcaaatggcccaggttctttcaacagatcagtgttgaagaaaggaaagggatagagagaaacctgtacattaagagacttaatggaaataatagatttttataaatggacaagaccttagtcttggtatagtgtcttggaatgcccatctggatgataaacatataaagaaacataaggaagtatttaacagtcaggatggtgggttcgtcttagagggaaggagatgacagttggggcagcgcagtcaaggacagggatggcagatgcatgtttctttttaacttttttattgtaaattaaagcacacacataaaaatctactcaaatacatagtttagtgaattattataaggcaaataaatacccttgtaactaccacctaggtcaagacatagggccttgccagccagcctagcagaaggaggacttgccaccatacctttattctgatgtttcaacccttagaaaacacttgcagccctcaccttggtcacaaaacatcaacaaatctgggttattgaccacaatcgaggcttctccatcttcactgtgcggccgatgatagcggcagtgcacaggcaaaaaggcttgaaaacagtcaatgcactgtgaatctcgtctggcataaatgagaacttcagactccttggacaaatagttaggggcctctatatcaaaattttctgaaaccatcactgcctgttcaaaaagaaaataaatattaatcaagaagaaatgaatgaggaagatttttaaaaagttaaaaccagaagactatatacagatacacagcagtgtcaaatttgccccttttataagcaatttccattccccttccatcctcaattttaaggagaaaaacacaagaccaatttatgcttaataaaagtctgcttactaaaaaaaaactggggaaattatattctagggtaccaaatttccccataataaaaattattcctgtaatattttcttattagtctttgcttaggtgacaaaataggtacctaagacagagaaattttgtgaatatagcattattcaataagtacacaaactgtgacaaaaggttaaacctgtattgagttaaaatgattggtatcattctgacaatttcctgttcttcagagaagcaagtgagatggcagtgagtaagagcactgcggtcaggaagtcaaagcaaaggtcagcactctttctagagacggtataaacagttaatggaaaaaatagtaaatgattgcttaaaataatatggtaaaaactattttatagaaaagtatagtattctacaccaaaagtgaaaatgtacatgtggcagaaattagacctaagttataacatgtatatttatttattacacatatatccacatatacatacatatttatgtacacacactcacatatatccacatacacacacaggcattatatacgcgacctatgtgtatatgtatggatgtacacacacgcacaacttctctttagattgtccatgcaaaaccctggtatgcattaactccttcccatcacatcaagcatcctaactttcctctgacagtgacaccaagtgctatgttttctttacatgttgttccttttcagttagtcacagcaggaacagaactcattggcaaaagtcaaggaattatatcatctcatgagtcatgagggactttggaagtaataaaattaaaccactgtcccaacaaaggtatttttcaggtataccgccactgcttgaataccttcagtgactggaaggaagctcattactataagtcatctcgatctatctactgttataaggttatttc

SEQ ID NO: 259 - DNA, 10000 bp, Homo sapien
tcagatttaggaatttattttccatttaggttttattaagtctaatccaacaatgcaaaaatgaaactgtgagttatatgtgatgaaaaagtatagctttcttgaattcaaataagcaatggcaaagatcacatttagaatttgacagaaagaacacagcatccctgcctcgtcttttttatagatagtaagaaaagggaaagtagtcttatttcaaatatcaaaattctgacttaaatgaataaaatttagtcacgagtaaatacaaaaaacaagcaaacaataaaaccttcctggatcagcacaggcccaattcttccctgccttttatcaccctgtcagctgggagtatcttttctacctgtggctctctaccaattgttactctcttgttgtctgaacctgctagccaaacttggcaggtcgttttcaaagccagatgagttctgattgttcccttggcaatatccattatttccctcctgggtagaaggaggatctgaggacagcttatctttttggggtacgtggagtagaggtggggactcttatataatacgaaataaaaataagttctttgggctggaagtgtcaaaagattccttagaatttatagccacagggatttcatggtgtgtctgatgtactgattttgtgccacatttgagccagaactggcagcagattcaaagcaacacaggtggctaagtacacatgaggggaaggtaggtatggggagagaaaagtggcataaaacaaggctgtccccctatgctcatcgagaataggatcttagccctcactgaaggagcttaatgatcagctctaatacattggctggactcctgcaggtactcacggaaagtagagatgctgagctaccttttcttgtcaaagtctagggctggagatgcttcaagaactttggagccataaagtcactgtaatggtcaacttttaaggctagaagaggccatgagacatctcattcatctccttgcctttgggcaagaattgcacacctaagcctcccgaatacatcagacacaatttagggttaaaagcctccagaggggcaaaaaagtaaaaagattttacaactttcttccacaaaccactttaattgtgtgctcatcaccgacttcagaatctaagagaactttgacacttgtttttgacaccccattgccttctcatcagtctaactccaagaccttcctccgagtggtaggctctggtaattcagcgaaagcaaggcgctaacaggcgagtgtgaagccaaagggctcccagtgacatccttgacatctttttgccagctattcacatgcatttaatatacagcacttccctgtgactgtctgcagccttttctaccagcaattcctcctgatttatccttctccagcaattcccagttgccttgcctttctaatagatgttgcagtctgacaaaacacctttgccttcatgctggtgttgttaaaggactgattataaccgtaaggaatgggaaataagaagctattccttgtaagtttgctaatcttatctgttcagaataataaaagttctctgtcaaagacttaggaagggagatttcatcccccagccttgctagtcctactctttgtgcattcttaagacaggaggcaagtgctttccattctccttggaaaaactgaggctgaatatgcagcttgtcatgcagttttgctgaagacagagagagggtcaaaaattcaaaaactcaattgctctagggcagggggttgggagcaaagccaataaataaaatgggtggtataaatgcctttcaggaaagggtgtgaagggtggggtggatttaccagaagctttggcagtcagctttgaagtcttctggaaaggaaagtgtagcctcccaggcaagcagcctcatgacatcttccataaggctgatgtgttgggaaacagcaacacatgagcaagaagttccttgaaaaattttcttccctccttcttcttctggaactgttgggaaactagattagacccaggagtctggtttttgagaatggccctgaatgaatttttagtttccgggtaggaacagagagctgagaaggttgttttctcctccaaggaaatctggccacagtttttttcctgttctatctagagcttgtgtgctggtggattaagcacatgtgtgcacagggccaggattctggcaaacaatctcagggaggatggcaaaaggagaagcaaaaggggttcattcctctacctcacagcttcttttcccaaaggaaacaggatctactcaccagcaacaatcccaacatcacaaaaggaacagggaaataaacgtgcatacaactgggacacacagacccctgtcacctgctacaaatggagcagaagtgggagagaagtgagccaccgagaacctaggccttcttagctgtagcctacttgaagagggcacgggcttcctgactggtctctggtggccgagtaactctacttccctgacctgggaagaaggcgtgaataaccagctaagaggagacacccatcctcttagagttgcctggggtatctgaggcagaggtggtagcagcagactcctcaacagaggcactgagatccaagaattccaggatgatgtccccaaggcagtaaatcaaatgcctgaaacgaatggacaaaaaacttagggtctggctcaatcaggaaacacaagatcctgtttatgacatttattttctcctcccccatcaccgacaccctaaacttcaatagcttgatgaaacctctgccatgaaattaatgttttttgaactaataaagcctctgaccctaataaaggcaagaacagtttttatataagactagttttatataagactaagttttataaaattccatttctctttacatagttacattagcactgctctgaagaactgtgataacaaatccttgagatgtcaggttactagacactttcagagctcctgactactgctgtttctcataattaattaccttaaatttataggctgccttacaggcagtgaggtaaagccaggatccttgaggaagttaacgaacacagtctactttggggtagggtttgagtgcaaggttactcaatacttccagaagagtaacagcccaagggatggaatctacctcttctggattattctaggactcttcacccagcatttctggtccctttatgaaattccaaccttactatcttgtctacctgatatgaagcaaagacaactcctggtcttgacatgaatcacagctttgctataaggccagggctcatggtgaacatctttacatggtctgtgatacacaggccagggtacgctcttggagcattcacaggggctggcagatgttggaaagagcactgagcaagtatgctgaacaagcctggaggataagaggtcattttcagcagctcatgtgggggcctgcatagagttcttccaaacacaaatggtgggtggtccaagagtgatttcctagcacatgacgacctgctcagaagcctgatggtgtggattttacttagagtgtgtggatctggacgtcaaactctgtagtcagtgcccagagcaagtaaagactacaatcctattctttggaatgtgggcttttcactcagaaaccttggatacctctgagaccagaggtggctgtaactatgctgatgttggaataacattttcccacttacctgttgatgaggggttgttgtagtgactccaggactagaccccagctcagccggcatttgttcaccccaagaatttctactacgagatctgaggaggaaaaaacagatggaatttgcgtgttatcactgaagttttagattctaaggacagtctctccccaggatctctgccgtttttacataggttaggtatttcgggcctacctctaaaccatacagccaaactaaaatcctcacaaaacaggaaaaacctgagaaaaatatgtttctcaagttaggtgtctacataagaatgggcttcaaaaattattttgtaacctgtcactcaaatgcaggtactccttccaatgtaacagtttaggttggcaaacagagttataataataagggtaaataaaactgattgtccagagctaagttcacaattgtttcctggttatcacagccataggcaacaaactgccttcctggccctctaaaaacacaatgcaaggaaaaacaaccttctcagattttgttttaacttattgctaaaggccatgtaccatactcaatggctgcaatttattaagttggagcttctgtgagacatgtgattttcttccttggtcccaaaatgctatgaattggtagagaatctgaagtcttcatctcctggaaatggctctgagacctgtccctgcaggcagagcttccccagacctgccagcaggtagagagaaagttattaacctaaatatctgcaggattgtcacctagtatttagggtgcagctgtagagttcctttccattcccttggcatcagctgagcaatggataaaagaattgcagccctgttcattttcctattagcctgggaaatgatgggtcaacagagttttgaatctagccacattcagggcccttttacaaacaggaaaaggtgcaggggtaatggtggcaaagcagaatggaagagaaatgtgattggtataattgatctcattggtccaattacctgggaggactcccatcaggctctgcaaagcctgtttctcagcagccagtttctgctcttgggtccttacgggccgtggaaacttaggcaaaactccaccaggccagatggactcctgaagaagcaggaggtactgcacccagcgctgtggacttgttaaattagctacctgcacctctagccacctgtggtagaagagagacgaaagcttagataaagctgaaggaaaggaaataacaaggcagcggactgactgtttatgttcccctgcagattcgtgtgtcaaaatcctaaccctcaaggtgatggcagtaggaggtggggcctttggggaggtgattaggtcatgggggcaaaggtaaatgcccttataaaagaaacctgagagagacttctcaccccttttgccatatgaggacacagggagaagacagctgtctatgaacaaggaaaagggcccttgccagacaccagttctgctggtaccttgatcttgaacctcccggcctttagaaactgtgagaaataaatttctgttgtttataagccattcagtttatggtattttgttatagcagcccaaacagactaagataccatgaattacatgagcaatcagaacaggacaaagtcagcactgactcttgcaaaggaaaccaagacaattcaacagcctgggataacagaatttgaagatgagtaacaataagaatcgtgttatttatggagcgttcactatgtgccatctaccgtacaagaagttttacagaacagaacactaaaagggcctccgtctctgggtgagcctgcacctataccttcccaactctcctctggcaaggctgcacctattatctttctagctctcctctgatgggaagcattataaccttcttggtaacatgtacacacagacttcacagctacggacttagcgatctttaaacaaattcctctctctacctccccagccatatcttctggtcctcatgactgtcttagggatttcctacatctgccctttgttcataatagttctctcactaacaagggcctcttctcgccttgcctgaagagcaagtctcaagtctgcccttctggcaagacctgtttcaaccctacttcctccatgaaatccttgaccatcacagctggaagtgctctccttctccatagacctcctttggcaggtagctctggaacaattactttggaatatgcatctttttaaaggtgtttatagctttacttcttcaactaaattataagctgtaagagttctgtgtcttgtactttaaaaaaactccccgccgtgcttggtgctcaagaaatggttgactgactgataactgttcttatttcaatgaaaaattttccctttgtcttactttcgaaaatgagtcaaaattttccctttatcttactttcaaaaatgagtcaaaaatgagggggaagatataccaaatctggagttcagctggaaacctagaaagtggttcaacgttattcttgatctgttcctgaatttttttcaaagtgatatggtcagaagtgaggttcaaggctgttgaggcctccccttcacccacctcatttaagactgacatagctgtgtgggtcatggatggacaatcaaccacttctattcatgcacggaagactcgtttgatcctgcaccacatggcagctcatgccatcactcctcgctcctatactcgagtcacttgtcactcatccaagagcagagggggctgccaaggcaaactttatttaacctccactctgccagacagtctgcattccactcaagctgggcattccagccatgagggctgcaatcccccaagcccaaggctcacaactgattctaagaataggaagtgtgtaaggtaatagcagggcaagaatggcagccatcgatggagatcaagagtggcacaaagctgttcttgtccaaaatagccaacacgatcgtatttgttattattagggccgcatctcctttttatagggcttttcattcagtgagcctaagatgcctgatgaaaggaatccagtagcaagaattcctgttcctgtttatgtaagagggtcactagagggaggtggctgcaatgacctgatcggcttctctgcaggggattaagtgacccaaggtctcctttcttcacctcaagccatgtatacttctgcaatttttgctgaggagaatgatgtgtcttagggtctcatctaactgtcttgagggagaggggcaaagtcttgcaaactaaaatctttagccacatgatccttcctagactgaacatgttgtaacatgccagcaagcctaggtacctcagccatcttctggcatgtcttacaaagcaagagttacattcttttgaatgaacattaatttatctgatggggacaggacctcacatggcattaggacaaggatatcctccttgttctcttgcatggtgattaagtgtctcatgtacatgtgtgggatgcaaaatgaattttatcatgtggcaaaatataaatttataaacttatacaaatctataagacagcttttcagactctaaatggaaatgttggggagagacataaaagtaggaaaagtaaaaataagcacctgatgatgaagatgagtctatgagtcaaataaatttgtggaagctaataagcacaactcaccgaagaaaaggagtgccatctctgagtaagtatcagctgctgatgagacaaagacactgtcaagcactgtacatacaaggcacagaactggccaacaggaggccctggaaaaagtcaggcccaggaatataagaaacaggactttcacaaactggcagaaataaactccctccaggcctacaaagagggacagagtttggaaagtgacttctagtccctgggagctgcagagtgccagctttccttattcttctccacactctgaagataaaagacacaaaccacacacttgcaccacgcatggtttaaacatttgctctctttcctggattctcctcttgcctacgttctgcccacccttccccctgtcagcaaacagaggctttatcctaggcctttgggctcagcatggtcttatttcctagtcccaggcagcctgtgtagaagaccaagtgcaacaaatctttcttgttcacagaacttctgagcgatggtgtctcgttaaaaatgatgagcacgccaatctggaaggaaaacatgataaagagcaaaccaaaaaaatcaccaccacaactgccactgccctcacacaatacaatctctaaattttttaagctgtaattcaatttctaagacacactttattatcactcactatgcctttcttaagttgtaaatggctgtatattcagggatttggtatactttgccttgcccaacacctggatggaaccaactgccactggttcttgagagcaatgaagaaggtggagatttcttcatccaaatatctttcctctccctttcatccctaccttcccttcctttggttctatcatccttctctaaggtaaagctccatacacaccaccatttcattatctaactttattaactcccctaatcatgcttgatttatttggaaactggctagagcacggaagacaaagacattaggtgtaggattgttaaaaggggcagaagtctcaactcctctccattaactctcttcatctcgcgatttctacactgcatctttctattcttatcataggagtgggaaggttaaaaagagattcgtaaccctatagagctctctttaagtggaagggatggaatttatgtgtctgaactctaatacatcataggaggttttccagcatcagtttctggactttgctggtaccatttactattaggctgacagaaatctaaagcttcaaggtcaacacacacacacgtttctcttactattcattagaaattacttataataggccgggcatagtggctcacacctgtaatcccagcactttggaaggctgaggcgggcagatcacctgaggtcaagagtttagaccagcctggccaacatggtgaagcctcgtctctactaaaaatacaaaaaaaattagctgggcacggtggcgcacgcctgtagtctccagctactcggggaggctgaggcaggagactcgcttgaacccaggaggcagaggctgcagtgagccaagatcacgccactgtactccagcctgggtgacagagggagactccatctcaaaaaaaaaaaaaaaaaaaaaattacttataataaatcatttactaaatacaaatgctcttgttcatgtaatacaagatgcatgaagtaaatatgctaaaataaatatggtagagaatagcctcagatagcactggttttattttccactactattccaggtctgatatttgatttagagatatctctttctattatcctgccttcatcccaaagaagagaagaaaaaagaacccaaaccaggtctcttgtgtcaagccatctctgaatgattcagagccttaatagggggcctagaaatagccagtaaaatggccaaaaaaccccactccacaaccacattttgaccccaagacattcaagagcttcccttatgccagacaggggagaagaaaggatgtggagatcagggcttgtcagtagctgggactgcacatccactccatgttcaagggaacctggtctgaaatagccgcagataggggaatgaagcaatgactaaaaaggagacagtttaatactagggcttaagatggcacttcaaggttagtagaaggtcatttcccatcaaaacagcagaatcaaatctcatgagtaaggagaaggctttagagaccatgtctaatccaattagccaaatccccttcatttcttttctaagacagcagctatggctgagtgagaaagggtcttgaatcagtatggcttaatgaagaggagaaagggaagaagatactaaaatcataaaacagaaaatattcataagatccacaacaatattctaaacaaaaatgcctggtgcagtctaaatataaggaaaataacaggtccattccttccagcctatttatctattggctgtacctctatagacaatccaagggcaattatgctccaaccttaagataccaaatacagttcaaaggaaaagagaaagaaaaggaagatcaagttaaagcttctatcatcctaagtacaccttcagtaaattagaagtattgacttatt

SEQ ID NO: 260 - DNA, 10000 bp, Homo sapien
acccaggctggggtgcagtggcaccatctcagctcactgcaatctgccttctaggttcaagtgattctcctgcctcagcttcccaagtagctgggaccacaggcacatgccaccatgcccggctaatttttgtatttttaataattgtaggcctggcacggtggctcacacctgtaatcccagcactttgggaggccgaggcgggtggatcacttgaggtcaggagttcgagaccagcctggccaacgtggtaaaaccatctctactaaaaatacaaaaatcagctgggcatggtggtgggcacctgtaatcccagctacttgggaggctgaggcaggagaattgctcaaacctaggagatggaggttgtagtgagctgagatcatatcactgcactccagcctgggcaacaagagcaaaactgtttcaaataataataataataatttgtaaagacggggtgttgctatgttggccaggctggtctcaaactcctggcctcaagtgctcggcctgcctcggcctcccaaagtgctaggattacagacttgagccactgcgcccggtggacattcatagtctaaactgccatctagggataccttgttttttggggcttcattttattgtacttctagatactgcatttttcacaaattgaaggtttgtggcaatcctgcatccagcctctataggcgccatttctccaacaccatgtgcttactttgtgatcgtgtgtaacatttgggtaattcttgcaatatttcaaacgttttcattattattatatctattatagtgatctgtaatcagttatctttgacattactattgtaattttgggggagtaccacaaaccactcccacataagacagtgaacttaaccaataaatgtgtatgctctgactgctgtaccaaccagcattcccctgtctctctctccttgggcttccctataccctgagacacaacgatattgaaattaggccaaattataaccctacaatggcctctaagtgttcaagtgaaaggaagagttgcatatctcttcctttaaatcaaaagctagaaatggccaggtgcggtggctcatgcctgtaatcccagcattttgagaggctggggctggtggattgcttgagcccaggagtttgaaaccagccttggcaatatggtaaacttcgtctctaccaaaaatacaaaaattagccagtctcataacccggtctctaaataaacaaataaatagattaaacatttttaaaaagctggaaatgattaagcttcgtgaggaaggcatgtcaaaagctgagacagccaaaaactaggccttttgtgacgaagagttagccaagttatgaatgcaaaggaaagttattgaaggaaattaaaagtgctactcctgtgaacacatgaatgatatgaaaacgagacagtcttatcgctgatatggtccaagttttagtgatctgtataggagagcaaaccagccacaacactcctttaagccaaagcctaatccagaacaagggcttagctgtcttcaattctgtgaagtctcagagaggtgaggaagctaaagaagaaaagtttgaagctagcagaggtgagttcatgaagtttaaagaaagaagccatcttcataacataaaagtataaggcaaagtagaaagtgctgatggagaagctgcagcaagttatccagaagatctagctaagctaattgactaagggggctacaatgagcaacagattttcaatgtggacaaaacgaccttctgttggaaaatgtcatccaggagtttcatactagaggaagtcaatgcccggcttcgaagcttcaaaagacaggctgactctcttcttaggggctattgtggctggtgtctttaagctgaagccaatgctcatttactattctgaaaatcctagggttctaaatctgctctacctgtactctgcaaatggaactacaaagcctggatgacagcacatctgtttacaacatggtttagttaatattttaagctcactattgagacctactgctcagaaaaaaaaaatcctttcaaaatattgtagctcattgacaatgcacttggtctcctaagagccctgatggaggtgtacaaggagattaatgttgttttcatgctttctaacgcaacatccatcttgtagtccatagatcaaggaataatttcaactttcaagtctttttttttttttgagttggagtcttgctctgttgcccaggctagagtgcagtgggtgcaatctcagctcactgcagcctctgcctctcgggttccagcgattctcctgcctcagcctgttgggtagctgggatttacaggcacacaccaccacagctggctaatttttttatttttagtagagatggggttttgccatgttggccgggctggtttcgaactcctgacttcaggtgatccgcctatcttgacctcccagagtgcttcaagtcttaatgggaaatacattttgtaaagctatagctgtcatatacagtgatttgtcttatagatgtgggaaaactaaattgaaaaccttctggaaaggattcaccattctagatgctattaagaacatttgtgattcaagggagaaggtcattgtattaacattaacagaagtttggaagaagttaattccaaccctcatggatgactttgagggattcaagacttcagtggaggaaataactgcagatgtgacaagaagagcaagagaactacaagtggagtctgacaatgtgactgaattactgcaatatcatgataaaatttgaatggatgaagagttgcttcttatggatgagcaaagtaactggtttcttgagatggaatttactcctgatgaagatgctgtgaatgttgttgaaatgacaacagaaacttcatttgtattcattaccaacctctcttcatcctcctctcccctcttccttcgcagcttctggtaatcaccattcctctctctatctccatgagatccactttttttagctcccatatgagtgagaacatgctacatttgacttcctctgacttttatttcactgaacataatgaccccaaattccatccagttgctgcaaatgacagaatttcattcttttttatggctgaataatattccattatgtatgtatactacattttctatacctattcatccattgatggacacctaggttgactccatatcttggctattgtgaatagtgcttcagtaaacatgggaatgcagatatctctttgacacactgatttcctttctttctttttttttgagagagagtctcactctgccaacccaggctggaatgcagtggctcactgcaacctctgcctcctgggttcaagcgattctcgtgcctcagcctcccgagtagctgggattacaggatgcatcaccacacctggctaatttttagacagggtttcaccatgttggccaggctggtctccaactcctgatgacctcaagtgatccatctaccttgtcctcccaaagtgccaagattacaggcatgagtcactgcacctggccaaggatctgaattcttttcttttttttaattaacattttttttttgagacagagtctcacttggttgtccaggctggagtgtagtggtgtgatcttggctcactacaacctctgcctcccaggttcaaacagtcctcctcagcctcccaagtagctgggattacaagtgtgtgccaccacgcatagataatttttgtagttttttgtagagagagtctcactgtggtgtccaggctggttttgaactctgagctcaagtgatctgcccacctcggcctcccaaagtgctgggattacaggcctgagccactgtacacagccatatgtcttcttttgagaaatgtctagtcaggtcttttgtgcattttaaaattggattatttgggttttttttttttgctattgtttgggttgcttatatattcaatctcttgtttgatggaagtttgcaaatgttctttgtagcttctcttctcttcacttgtttactctgctatgcagaagatttttagcttgatgtaatcccacttgtctatttttgcttttgttgcctgtgcttttttttttttttttttctttttgagatggagccttgctctgtcacccaggctggagtgcaatggtgcgatctcggctcactgctatctccgcctcccgagttcaagcaattctcctgcctcagcctcccgggtagctgggattacaggcaggcaccaccacacctggctcatttttgtgttttcagtagagatggggtttcaccatgttggtcagattggtcttgaacccctgacctcaggtaatccacccaccttggcctcccaaagtgctgggattataggcgtgaaccatcgcgcccggcctgttgcctgtgcaacacctgttgaggtgttacctaaaaagtctttgcccagaccaatgtcctggagcatttactcagtgtatttttttagtagtttcaggtcttacatttaaatctctaatccattttgacttgatttttgtatatggtgaaagataaggatctaatttcattcttctgcatatggatatcattttcccagaactgtttaccagagaaactgtcctttctgcagtgtatgttctgggcacctttgtcaaaaatgggttggctgtatatttgtttctgggttctttattctgttcctttggtctatgtgtctgtttttgtgccagtactattctgttttggttactatagttttgtagtacaatttgtgtagtatagaaattttaacaatattaactgttccaatccatgagcaagggatagctttacatttttgtgtgtgttctcttcaatttctttcatcagtgttttataaatttcctcatagaggtctttcacttcttcacttaaatttattcctaggtattttactttttttgtagctattgtaaatgtaattgctttcgttttcagattgattgctacaataaaatattttaaaatattacataaacttagctcataaagcagtggaaagatttgagaggactgactccagttttgaaaccagttctattgtgggtatgtaaaatgctatcaaacagcattgcatgctacagagaaatcttgcgtgaaaggaagagtcaattgatgagaaacttcattgatgttttattttaagaaattctcacagccactccaaccttcagcaaccactatcctgaccagtcagcagccatcaacatccaggcaagatcctccaccagcaaaaagattatgactccttgagggttcagatgattgttagtattttttagcaatagattattaattttttttttttagagataaggtgtcacattgtcactcaggctggagttcagaggtgccatcatagcccactgtaaccttgaactcccgggctcaagtgacaataaactattttttacttttatttattttagagacagggtctcacttgttactgaggctggagtgagcttggctcactaaccttgaaatcttggcctcaagtaatttacctgtctcagcttcccaaagtgcttggattacaggtgtgaatcaccatgcccagccctataatctgttttttatttagggtgtctacatctttttagacataatgctattacacacttctaagctataatatagtataaacgtaactttttaaattattattttgaggggagtttcgctcttgttgcccaggctggagtgcaatggcatgatctcagctcactgcaacctccacctgctgggttcagttgattctcctgcctcagcctcccaagtacctgggattacaggcatgtgccaccatgcctaattttttgtatttagtagagacggggtttcaccatgttagtcaggctggtcttgaacccctaacctcaggtgatccacctgcttcagcctcctaaaatgctgggattacagggtgctcggccaaatgtaacttttatatgcgctggaaataaaaaaaaatgtgtatgacttacttcattgttgtggtctggaaccaaacctgcaacatctccaaggtatgtgtgtattctagattagtgctgtcttatagcaacttgtgtgatggaactattctatatatgtgctctccaatacagtagccactagctacatatgactattgagcatttgaaatgtaactagggcaaccaaggaacggaatttttaattaattctattagccatagggaatagaatcatggaatgaccctttagacagagattctcactaagtttggggcaaggtccaagaagtgatgtttaaccaaagttcccctggtgattctgatgcatacatgcacaaaatagttttttgatttggaacttgataggtgtataaaagctttaaaaagaacagggttctttttgaggtttagttggcctagttcaagagtttataggaataaggagatgaagtaatgtctccctccattcaatcctcaaacaattgagagaggaaattcacctttatcatctgagtgtagcaaacaccaagaacagaatacattttgaatgagaggaagagactggaaaatcaactcagggaaaacaagtgagatactgaacaccaaaaatcctgggatgaatggtgatttctatgagcaaagcccagagattgttaactgaataaacaggtcagataactgtaaacagcagtttcaacaacttgcgtgttgaaagtggaacttagaaagtggatgatcccacttctctagagacttagtggttggaacaggaaaattttgaataaattaaaaagaaagggctgggtgcggtggctcacgcctgtaatcccagcattttgggaggcagaggtgggcggatcacctgaggtcaggagttcgagaccagcctggccagcatggtgaaatcctgtctctactaaaaatacaaaaattagctgggcatggtggcaggcacccagctactcaagaggctgaggcaggagaatcaactgaacctgcaaggcggagattgcagtgagccaagatcacgccactgtactccagcctgggtgacagagaaagactcatctcaaaaaacaaaaacaaaagccaaaacaaaacaaaaaaccagtgaacaatagggtaaaaggggacctggaagagacttgaaaaactgaatctttacctcatgcctcctgacagtatattacgtcgaatagcttctgagttgcattaggatattcattcccaaagttgtaggttttaaaaaaactggacacttgaggtaggcatttccttactatatctcacttaccacatggaaagttattatcttcacttccaagaatattgatggaaagtatatttctggtggaaaaatataatggaaatgaggaaaaaaggcaaaatatcactgtagtagagtgaaaaagacaatctttaacccagattggaattctggttcttctacttattgccagtatgaccttgggcaagcttcaaacccccttttaactggagaataactagaatttccactctttttctgaagtatggtttttaaggactcagtgacatataaactgactgtacaatgcctagcacattgcaagcattcagatattctcttccttctccccatgtccacatttttgccatatctcccacagacagcccatgatggagtagaatgggctgattccagtgctatatacggatagtctagggatttagagttaatgctcaccaatatgaaaagcctacttccgtttagattgatcctgttttcctaggtctagcaaaccatatggtgtatcacataccaaattttcagcagtcaccagccctgttaaagcagtagctgcaaaggtcaacttgagggaggggacttttacatttactttatatacttatatggtgtgaacattttttataataaacatgtattttatgtttataaattaagttagaaaagaatcaccactttattcataaagttaattaggaaagagtgaggatttcaaagatgaaggctttgaaggagaaattttccccttccttagccctcagggaatgacagatctggtgagggcaaatggcaagaggggagaaacttccgttgggtattttccagctagacttcatcactttgatttttttaattctgacagattttagcattctcatcgaagaaaatctccaaaggttatttgtgatcccatagttccttttttttttttttgagacggagtctcgctctgtcacccaagctggagtgcaatggcgcattttcggctcactgcaagctccgcctccagggttcacgccattctcctgcctcagcctcctgagcaggtgggactacaggcgcccgccaccgggcccggctaattttttgtatttttttttagtagagactgggtttcaccatgttagccaggatggtctcgatctcctgaccttgtgatccgcccgcctcggcctcccaaccgtagttcctttttaaagggagttatcagttatgactcattttactgatctgcaacactgccaggtgggcctgcagtaagatctctcgtatctatcacaggtaaccatgttggttgtctgctggtatctttctgtgcatgccaacactcaactgttatataatccagtgacataatctttgaatacagataatagagatgtggtaatgccttggcctataactacacaagggtagagaaagaaccagcgtgatagagacaatgccagggcaagtgagaacagacagacgctgggtaattatacctcacagaggaaaaacataagtgaaaaaggccctaagaagtagaggagcaaaaggtcagcacgtgcttgctctgcacaaactttccaggaagaaagcacaggatgcacccaggtgttccattcaacttcaaagtttctaaaaagtgctcagaaaggttggaagactgtttactagaaagaattccggtgtggtatccatgcaaaaagacacctgcacacaagtatgtgactattttttgggtaaactttactggagaggtcaaaaaagaaatttaaaaatgtttttgatgtttttcaagttttatataaaattatcaatattgacttttgccaaatgcatatctagatttatgtatcgaaatgcttatttcaaggattagataacagaatttaagaagagaaggcacattaatcatatactctcaccacattttctcaatcacacagacctggaaacattaggggactcctagagtcagttccatcagataccattagagctgggactacaatccaaacctttgggtccttgtcccatctgttttccacacagtctaaagattgaaaacaatcttcataaatttgtaccactgaaatttttttttttagttttatggaatataaatagcctttttttaactgatattttaaaagaaatatataaaaggtatctgcttgccattccacagcctgctggcctgcagccacacactcatcacctggactgatagattctcttaagcggtctaatgcctgggtccaaaagtagattttctcctttcccaattccagactgcttaccaggttctagattcccaggtctcctgggtctggcctacttgagtggtctttttttttaacctgcggtcatagatttctaccagcattcctagtatttttgccttgttatttaatctgctgttgcccgctgtctgagcacaaacatctaaaaaccaccctgttctttccaagggtgttggaagacagatttctgatgcacttagtgataaattgggaacaagactcaagacatcttccccctccctctttgcagctgtagagctagaatgaaaatgtctaatggctaattcactcaatcacataaatgtctcatctacaaataaaagccaagtacacgtttcttagttttttttgaatatatttaca

SEQ ID NO: 261 - DNA, 10000 bp, Homo sapien
tgaagaaatgagtacttttttagtttattttaatgcctttaagtttttggtgacttttacatttggaaaattacataaggtaaattatttgtagagattacaaagttagccatccatatgattgcacttttactataaggagatgccacacagttctctgcccttgatgacctcatattatttttgctgcaagagaaagcaaacaaatgacaaaaggtgaatatgaagacaatggaaaatgttatataaataattgccactcaaaagtcattctttaattcctgacaaattttggatgtcaactcaatgaggacaaatttgtgtaaggataaatttgtcaacttatcacagatgatggagagtgactttaaccaaatcatttctcttctctggtcttcagtttcttgatctgtaaattgaaagactcagtgtagctggagctctgatactccttcttcactgcaagattgcatgattttgtgaggtacatgaatcatttcacatataagttaaaaagtaatgtacactttcgcacttattccagttaataaaatgaaattataattgatataataaaaagtaactcatttgataaatcccctatatatgttctcatagtttcaaaatttatattttattttcttttgattctggaaaacaaattaaggtcaattctgaatataatggtaaaatgaatcacaactcagctattaagaaaaattatatattagccttctttattttcttctctcctttttttttttttttttttgagacagggtctcactctgttgcccaggctggagtgcagtggtggcgcaatcacaaatcaccacagcctcaacctgctgggctcaagcaatcctcccacctcagcctcctgaatagctgggactataggtgcacgccaccatgcctagctaatttttgtattttttgaacacggatttagccatgtttcccaggctgccctcaaactcctgggctcaagcaatccgcctatctcggcctctcaaagtgctaggattacaggcatgagccactacacctggcctcttcctatctcttacattaatttaaaagattaataaatgcatggacagtgttttagatataataaaatattaataaagacatttatatttttatatataataaaatgattagtttaccaacaatcaaaataaaaagatcccaaagccacagataaggatagcctacagtggtctttatgttcctttgtataattccttttttttcagagtccagtcttggatgtaatccaattgcgataagaagtcactcgagtatagacacctggcttattctttttaccacatccatcaccccagcttactattccaacaagatgccagatatttctggaatcagggtaagctagtggtccaccagaatcattctagaagaagaaaagaaaaaaatgtttcttgtcttaacaaaaaatttccttttacctctcctgtggagttatctgtacctcctgggcactgaaaccaattcactctctttgggcttagaactctgaaacccttaggacttttttttaaaacacaagacagctacaaaccagaatatatggcctaaaactgccaaatgttgacttgagcaaaccagagtttgacttatataatgagtgcagcttgaatatggagaaggtgacttagctgcttgcactgagcttaagtctctatgatgaagcctctgaggaacaagtggcataggcatgtgcccagactcctgatgcatctctggataaagagaagacaacattctaggtctgcaggttgcccagaaaataggacaaaattcatcttgtaaacttcttctaagtgttattctttgtatgaattcccagattgaaaacttcgtgagggcaggattgtgttcacctccacgtccctagcatgtaggctagtgtctggtacataaatggaattaatacatttttagtgtattgaaatacaaagctactatgtcagtattattaacacaaaaaaaattttatgtggataaaaacttccatttgattaactgggagaaaacaactggataatgtaactagacatacctgacatgcatcagcttctcctgacataaatccagcacataacattgtatcagtcacaaagccagagtatgcatatgaggcattgcaaattttgttgtcaataatcttcaaaaaggcttcttgaagtatcactggaaatgaacctaaaagcaataagtgctgcatattatgcagatcttagactttgctgggacaaagaatatctacctatagcataaagcagactctcttggtcaccaagagtcaggccagtcccaggttagattagtctctttcaggtgtttgtaatagttggctgcctaacacataatttcaatttttccaattcccattcccagagatattttaggaagtgaagacaatttgacatcatgctttttgtcccaccacttggttttcttttcagtatatttactgattgattaattgcatgaggggatgattgattgattgattgattgattgattagttattcccatgcagctattatgattttacaaaaaaacttaccattcatataaagtgttccccaacctgtaactacaacattgtcattttctgagagcttcattttggcttcaggaagacaaatcttacgaatgtactctgtaaaagaaacttcttcagcaagctgcacaagggcaatatcatcatgaagcccaggactgctataattttcatgaaaaataatgttttggactttccgtgtcatatatggtttatttactacaattccaaagttgacagtccaatcttttgaattatttttcctagaggacacaatgtaattagaatacactcagttgctgggtcacaacactgttcttagtggtgattatctcataattttaaggcatgaggttcccaaacaaaactataaaccactgaaattctattttgaaaactatctttgacatggagctgttgtaaatgttgcagtcacttaaaaataatgctaaggactcagatttgtcagctttctgaagatcttttcaagtagagtcactgatgttttcccctgcttattcagttccatccagtttctgaacatttaatttggtcaggaatcacatgagcgtcctcaattccgtaagtggatggggtccaggattagtcttattgccacatacccttggtttcaatagctactttttttaccctcacccttctaccaccctcaagtaggccctaatgtctattgttcccctccttgtatccatatgtactcagtgtttagctcccacttataagcaagaagatgtggtatttagttttctgttccagcattaattcatttagtttggataatagcctgcaactgcatccatgttcctgcaaaggccatgattttattcttttttatgactggatagtattccatggtgtatatgacccatattttctttatccagttcaccgttgctgggcatctaggttgatttcatgtttttgctattgtgagctgtggtgtacatacaagtgcatatggctttttggtagaacaatttatcttcctttggatatactcaatttttgggtccagattaaattttacgtcagatggatatgctgtctttcttcaaatttccatcgtacttactatctttgtaatacgtgtcatgtttacaatactatacagcctcgtacttttaatatatgacatttaaattttctcaactagattataaacttctggatggcaagacaaggaagcacctagtaactggagtcagacacacttgaattcacattcagtttctattatttaagaactaggctgggcatggtggctcgcacctgtaatcccagcactttgggaggctgaggcaggcggatcacttaaggtcaggagttcgagaccagcctgactaacatggtaaaaccccgtctctactaaaaatacaagaattagctggacatagtggtgcgtgcctgtaatcccagctactcaggaggctgagacaggagaatcgcttaaacccaggaggcagagtttgcagtgagctgagatcgcaccattgcactccaacctgggcaacagattgagactccatctcaaaaaaaaaaaaaaagagctgagtgatcttagccaagttttgtcacctttcctgagtgagacttagtttcctcatcttcaaatggttttaactataccttccatacagaattgaatgttgtgattaaatgaaatgatgttaagtaaagcacttaatgtcaggccaaggtacctatttggaaaatgttaattaatacttctatttgcttttctctcctttctctaatttaaatgcatttcctgctctttaattacgcaggtgattgtaaatgttctatgtgattgtaaatttcatatggccttggtgaaccttgacacattaagttaacccctacaaactatccaaaatagttttgcacctagcatccttcatttagtcaaattttcaaacttacttagcaaagcagtgagctgcagataatagccacctgctgctgatcagagaggctccacagtagtgacggcctttccattgcatgctggcctgccatggccatgccccctccagggagctttttccattcacaattttgttgccagttatgatactgttggctacttgtctcccacaacctagagaaaggatttatttacacgagagcaggtatctttgattacgcattataaaaaatatatcattaaaaattacttgaaacctttcagtgattattcaacttctcctaattgatgacgtttctttcctacaagatactcctgtgatgtttctgtattctatcttggtttgagtggttcttacttatcctcttttccagtctcaagcatctttcaaccactattttttgttgtgtctatgtgttataactcttgtctctctaagcagattcttgaaggaggagctttgcctcattggtgtctacatcttgcatagtatatgcactgctgtctgtaagacaccatgtgaacaaaagatactccataaatatccatggagtgaatgaatgcataaatgtatcttgtggaaaacatgatactctaaagagaatttatttaaaagatgtaacaggacagcgatatgctcctataggcccagctacttgggaggctgaggcaggaggactgcttgagcccaagagttccaggctatagtccactgtaattgcacctgtgaattgcactccagcccacacaacatagcaacatcccacctctaaagcaaaaaataataataatttttaagatgcagaactgtttttatctttaataaatatattttatatagcctggttttatattttcttcttatcctaaattgtcatttccttcaatctttctcattttaacatattcaaatatgatatttttcactcacaattttattatttggaatcaattttcatttaactttttatatattttttaataaatgttaaaattaatagaccagtgtttttcaaagagaaattctaagtcaatatctggtatatctagtaattcggaaagcgtgttatgggatttccacatgacatatttcaagtatttttaatagaaaaataatgagaaaatacctgtgagtccatcaaatttataattaaaaggtccttaacttacagttgttggtaagcatttcagaagcagccttgctgatttctgaaagtgaaaaacaaaacaaaatataaaattgagcaaatatcaccaagcaattgacttcaacctaagaacataaatgctaactttcctaacccaatattgtccaacatttaactatttggagtagttcaggtattttcagcccctctgactcttatttgttacattataaccatctctccatatctctactaggtagcctagaaaaagagaaaagggaataaaaaacaaaaatcagttttatgattattgaagtaaaatattcagtgctgtaagaagctggcacccttacaaattgtttttttattatactttaagtttcagggtacatgtgcacaacgtgcaggtttgtgacatatgtatacacgtgccatgttggtgtgctgcacccattaactcgtcatttaacattaggtatatcttctaatgctgtccctcccccctcccccttacaaatacttttaagagatcatgatagagatttctttcccatgataattctctttactctgaaatgctcagaattatatatattttaaggaaaaatgtcccaattaaaattatacttcactgagcccatcctgctctttagggaaatctccttactaagaatgaatcatgaaattttgagaacttaaatttaaatctttttcctattggtaaaagactttagagagaaggagaagaggaggaaactaaagaaacactagaaaatgctgactatactctatgggacacagaaagagagtaaacaacgtatccctctttcccaaaagctactcacagaaaaattttattgctcccttgaaaagttctacctcaggttcccttcttattagtggttcactggtaacggggtctttattgtgtggcaaaagagcggtaactggcagatgttgctggcctttcaagccctcgaagaccctaggattaattgtctggctggaagaaccatgaaactggactctgaaatcatatgcttatcacctagctggacttttaacaatccaagtgacagtttcaagacctttgcaaaaccttcacaatctttacaaacttcactttctgtaaggaggcaaaatcttatcatttttctgtgagaagcttttgggaaagagggatagattgtttactctctttctgtgtcccatagagtatactcagcattttctagtgtttctttagtttcctcctcttctccttccctctaaagtcttttaccaataggaaaaagatttaaatttaagttctcaaaatttcatgattcccttgttttctagggaattttccagacaatttttttctttaaaagtggtattactccagttttttcacaaaaatcaataagaactcccatccctaacattgttcttaactcctgcagtctccttactgaaagaccaagaaagccctaaatctgctttctgtcatgagatcctgacaaaagcaaggagtagaaaagaaagatactttgcctgggctcggtggctcatgcctgtaatcccagcactttgggaggccgaggtgggcagatcacaaggtcgggagttcaagaccagtgtgactaacatggtaaaaccctgtctctactaaaaatacaaaaaaattagccaggtgtggtggcggatgcttgtagtcccaggctgaggcaggagaactgcttgaacctgggaggcagaggtttcagtgagccgagatcacgccactgcactccagcctgggcaacagagcaagactccatctcaaaaaaaaaaacaagaagataattcaattagaacccttcaccccctttcccatgcataatagccaaacccttccaaacttacatccatgcttgcagtgtaaccctcattcctatcattcttcagacaatgattccatggcactgccctttccactaccaagtcattgctaggggtgccagagttaggtacgcatatttttttcccgaattactaaaactcttagttcactttttagtactttttaaaaaaataatccagaaaaaacctatgtaatagaaaataatggaaataagtcaaatacccatgagtttaatggaagcaggaactgcattccaggatgccatgttgtttttcaacatctgatgtaatttagccttgattttagtcctcatgctaactccttctgctggaggaaacttgaatttcagctgtaactgcacatttgaaccattggcattaggcctagaaacaacagaaattttctaatgtactgtttcttgatcttttagaggttttgtgaacacattaaatttcacacattttaattatcacattttctttacatatattaaagaaaaatatacatatactatctaagcatgtataaaattcaaagatatctaaaaaaacttctagtacgtctagttcagatgtgctattcatggaagaaaatatagaccacaaactaaaatcagaatatttcaaacactatgggaaatggaatactggccaagaaatgattggcatgaagtcttactataatacaataaaaaccagtgctctcataaagaatttttctaataacttcattttatagaaagagataaatgagaaaataaagatagggcagggaagcattcaaaagacaatttccagcatgtatttagaagccagtgctaaccttcttcctacggtttttttatacataaccagtctgccccaacagatctatacaatgaaaaagctcagaaagagaattctaaagcatgaaggacatcttgattatatattcagtacattcttttgattaatcaggaaaagagattaattcattttggaagactttcaaaccaaagccatatcaatcagaattgttaaaatatccataatttcactttcaaataattatgatcaattctagggtctttgaaggtttttgtttgtctgtaggtaagtaggttggttaggtcagctggattttttgtttgttttgttttgagagttcagaattccccagaactgatattaacaattaccaaattacaagtgggctctaccctcattactcttcccccatacactataccctcctccctgcatccctccctaccaccactatcttcaggcatccttcaaaggtgtgtctagacaaatgttgtcttaaaatattgtctttgttccacagccattgtaaggatgataattattaaggaaactaaaataggatgtttttagggaaggtatgggctaaaaacaaaccagttgaattatttgttttccctggagttataattatctttcatcatagcagtcagttaggactgaccaccaccaataaccttataattcttttgcaggtataagattaaagatttgtatataatgactcttgcccagaacagaaatttgctagatacaatgatactttcattcatggagaacttgatctttctttttctttttttttctatttccttcgttccttcctttctttctttcctttcctttgtttctctttttctttatgtttgttttttgttgttattgttatctaaaatcaaggttgtatgatatatcacctactttcctttcataaaatcttaaatgaacttgtacttacagaagtttgatgacctcagatttgacatattccttatatatactggaattttgaaatgcatttaacatctgacaagagaaaaaaaacagtcatcatgtatgtttcaatcaaatttataataaaattaattttaaaaatctctgatttaccttagtctcaatatctttgcttagatttgtgctggcttgtgaagctgcgttttcacaattatcattgtatgtgactccagaaatatgaaaatcaccttgataatagtaagtcttctctgcaaaattaagaaaaaaaaaacctcaaagaattttaaagtggaaagtgactttaaagcgatttatacctctgcctcaacattccacccagctttagaaataatccatttatacctctgcctcaaccatttatacctctgccttaacatttatacctctgcctcaacatttatacctctgccttaaccatttatacctctgcctcaacattcaacccagctttagaaataatccaagggagggagaaaaataagaggagaggagtgaacaattgtttattccagaaatggcaactccatatcattcattcaatgatccccgctttccctttatgtgataatagacattactgtcctgctaagtccagatataccctcagcaccctcctcaaaaca

SEQ ID NO: 262 - DNA, 10000 bp, Homo sapien
atatagttttgtaactataaacagccttgtttgtggatttggaggtgaatacctgttttcctaacttgattgtgagctacatgaggacagggaccttgtctggttttatctataagatgctcaatgtgtggttgctaaacaaagagtggacagacgcctcggtttccccagctggtccctatgtaggctgatctcacttgatgggagtgagtgagtgaggaaggggaccctctggttctggagcctctcatctggccctgctgctcagtattcattgatccttcaaatgtcagtgtgtccacaggagagaaagggtggcaggtagggctggcagaaggcagatgtgtggctttatagtgatcctatgcttggggctgggtgggtttcagctggggtgtgggagcagagaaattggctttgggaggctctgtgatgggggccttgcagcaggtgggtggtgagggcagcatggaggtggtggctggcctggaagggaggaggacactgggtggctggggtgccaagagagtcctggtgggggctggtagctgggaaggctgggcagggctgcccgcaatcaagagggtgacaatgagtatgaagagtatgcttagtggaagtgaaggcctgggaggctgggaggaccagaggttcgtctcccccagccgcgcccttgctccttgctctcatcttcctcacccttcctgcaccctggccgcttgggacctcctcttctccctgatctggtctttcagaaatctctggcctctaacctctataaccccttcctctcccagcctcccagccctgtccactccccgagtcacatccccaccagccctcctgccctgcctgcagcctgggccctgctgagctgccgtgcccttctctcatcacctcctcctcgctccctgtggcaccttggcaccagccccagatctgtgtgcactgatttcccaacattcctgtcctccttcccaccccactgccccaaagggaggggctcaaggacttgagacgcttcccttggggggcccagctttcccccagagtcagggagggatgaaggcagggctgctggagggctgggcccgcagacctgtggagctgcctagtgggaggtagagggctggagtgggagagcatgcggagccaccgtgggggcaggagatgcagccctgcaaggccacactgctctccccagcttcccactgtctattggtcttgcctggtgtcacctgcccttcccagctctgcctctgacttctgcatctcccctgatcctttcagtttctcatggtccttcttatgggtgattaaggagttgggccctaggccatttctggaaggcaggagttggaggtgagcttcctgttgccttgtgtgtgtaactctagagtcccgtaggtgggtggctgctggacgtgccctgggaggggaaagggacctgtaagggtgtgtccataaacagagcgattctagaactcagggatgctactgtggacaggacttagagattgttcagcccccaccctcttccacaaccatttatagatgaaaacattgggctttaagagggaaataggattgacatgaacgagtcacgtaggggttagtaatcatcatcactgtcatcatactagacatttattaagtgcttactatatttgagggatcattgtaaattctttacaaatcttaattttcatagtcctcacactaccctgggaagcagctgttgttattttccccattttacagacaagggaacagagactggaacagtgaggtcagtttccccagatcacacagaaagcctgtgtcagagcagtggaagtttatcacacacagggaggcttgctccttccaatgatgatgtaagcgtataagcattgttgagagctctttaaaacagtggcagacatttcaccaaagaagatagaggaatagccaataagcacatggaaagatgctcacattatgggcacggtggtgcatgcctataatcctagcactttgggaggccgaggcaggaggactgcttgagcccaggagtttgagacgagcttgggcaacatagcaacacccccatctctacaacattttttttttaaatagctcatgcctgtagtcccagctactcaggagcctcaggtgggaggatcgcttgagtctgggagttcaaggttacagtgagctatgattgtgccactgcactccagcctgggtgacagagtgaaaccccatctcttaaagaagaaaaagacatgctcaacatcattagtcatcagggaaacccaaattaaaattacaagatacacctactcaaatggctaaagttaaaggaaaaataaggctggaaataataaatgctggcatggatatacagcaactggaactctcattgctgattgaaaagcaaacaaatgctttggaaaacattttgacaatttcatataaagttaaacatacactattaatataactctgaaattcaattcctaggtctttacccaagagataaaaacatagccaggtgtggtggcttacgcctataatcccagcatgcctgggaggctgaggcaggcagatcacttgagctcaggatttcgagaccagcctgcgcaacatggtaaaaccctgtctctaccagaaatacaaaaaaattatttggtatgttggtacatgtctgtagtcccagctacttgggagactgaggtgggaggattgcttgagactgggaagatgaggttgcagtgagtagaggtcatgccaatgcactctagtctgagtgacagagtgagactctgtctcaaacaaacaaacaaacaaaatccaaaacacataagcccacacaaacatctatatacaaatgttcatggcagctttattcacaatagcaaaaaatggtaaacaactcaaatgtccatcaactattgaatggaaaactaactgtggtatgctcatataatgggatactgttcaacaataaaaaggaacaactgatacagacaatgacatggatggatttctaatgcattatgctaagtgaaagcagccaggcacccaaggctacaaacgaaaattcctgcacttatatggactctccagaaaaggcaaatctataggaacagaaaatcgatcagtgattgccaggaacagcagactgaccatgaaggagatgagacaacttcttgatgtgatggaaatattgtatatcttaattatggtgatggctgtactgcttaaacatttgtcaaaactcatcaaactgtgcatttaagaagggtgccttttattgtatataagttatactttcctaaaactgattaaaaaataaaaacaatgggctgggaaagggaagaaaataggatggtcatggtcatccttattgcaaaagtgacctctaagacttggaagaggaagcaggggagctagggctgatccctgggggaagagcattccaggtgggagggaacagccagtgcttcagtgccaggccaggacatgcttggcctgctcaggaacctgtaaggagtcggtgttgctgaagtggagcaagaggccggccgtagcggggctcagacaggcaaatgggcaagggatggatcagggctgggtaagggctgggtaaaggcttttcctctgggtgagatgaggctgctagagggctttcagtgagcgtgatccgacttgattttaataggaccacgctggctgctgtgttgagagcccgctggggacaaggaccagtgaggaggccactgcaagaatccaggagagagatgatggcggctcagaccagcgcagtggcctggttgaacttgggatatatttcgaaggtagagccaacaggatttccggccggattggatgtagggtgtgagaaacagagaggaggcaaggatgacgtcaagggttttggcctgagcagctggaaatccagccgggcacccccgtgggggctgttgagtggttttaactgtctcctggggcctgtgggtgaagctgagacagagaccgaagggaggggctgagccctacccctggctctgtggctcagggaataggctgcacatactgattattccattaccctttatttattggccttattggcttttgtcatttccttgtctcctgtctggagtgacagctataaatgtgatagattgatacaggatacaggagccccaattatctctcttaaaccggcttctcttaaacagggagggctctcgggcaagctgtccctgccctctgccttctttgccacaagtcctacagtcttccttacagaagtggcctggttctgccagggggggagcgatgcctgggaggatgagtggcagacatgggccccaaggggagatggctcccaggacaaatactggaggcaagttcggccccctggccagtcgcaccaaggatcccagtgcacactccctgatgctctgcctcacacagaggccagcacagagtggggcaggcgggaagacaggacatactgctggctgctcagcccacatccggggaagggggctccactctgaccttgcatgcctttctggaatccgagccggcctgtctgtccacagaggctgggatgatggggcttttctctccggcagcaggtgcctggcagctgccggggatgccagctccgtgagctggcatgggaggaagtgcttgtcaggatggtcattacacgtgctgggctcaggctggcctggccccgacccctgccactcaggctggcttgggatacccacatgaggatggcgcttcctgaagggaccctggggtccctctgggatgccctcggatggagcttggcaactgccagcctttaagtatcatttctgaactaagttcctcacccatcctctctgcttgactcttctctggcctgtctgcctacctctgtccctgggaaagtcctgagggccctggcccaaggaggtttgggacaggaagcctgacattcattctcgggatttgaggcatctccctgtgcccctcctcatccttgacagactgactacagcctctgtgccttgcatgtgcacaagtgcatggtgaatccacacgtgtttatctggcaagaatttcaaatggtcctgtgtctgacctccttccagaaaaacagagtggaaggtgggactgctggtgagaaaaggggcaggaaacttgaggggacaagaagggttcaaacggaggagcaggtccaggggaactcagcagagagtgaattggctgatcaatcagtttgtttcttctgcaaacattcccagctccttatctgtgccaggtgctggggcaggggctgaagactgtgttatgaacaaacaggtctggcctggccttgcacagcccttagactcacaggtgggctgcacagtaagtgtgcttagagcaatggtggggtgcaaaggtaccgtgccagcacacacagactctcagaagcagccaggggcaggagacgctagttcctgctgttcctctgagcccatcagtggctgccctttggcatctttgccaccacacccttgcctcactctcagttgctgtccccagttgctgtctctgcctgtaggagtgcctgggcttctgtctccctggcccctcccaacctcctgggctttgagtctcgtggccatcagggctgatatcggaggagctcctggcacgggggtagggaagctgccaacactgctgtggcccccagggtgagagctgacgtctgtccaggagcatctctctccctgccaagggctgagatctctgggctgcatgctttcccgctgacacaggagccagcatccgtcactcacagggccacccgctgcctggaccccagcctcaccccagagtgacccagtgacagctgcagccttgctgcaagcacaggcctcctctccctgcctcagccacttcccaggctcactcactccttccaggtgaacccacccacatcccaggccaggtgagggcccacctcaggcagccagggaagaccccacccaaggggccgagaagcgtgggctccaagccttggtttcaagaacaatgcgggaagctgcccgctggcccagaccaaggtggtagttaggatccctggagcttgtgagaaagacctgactcccctcacagcctcacagtggggtcccagcctccagcttccctcctttcctcacacataatagtcattgagttaccaccatgtgccagccactgagctagtcccgggatgcagtactgagtaaagcagacatagactctgttcttgtgctgcttttaagtttttttcactgaggttcctagtaagaagtttattttctatcactcaccaggatacacacatgggcactcacccacattttatatagagctgaatcaacagtttctccaaacaacactcactcttaccacatgggatatactgctattttaaattctgatattctttttaaaaaaaaaaaaacaaaaaaaaactggacatagtctgccatttgaaaagctctcgtgtggctggggaaagatgattagcccagtggtgaatggactatccctgccccggtgtggaccaaggaaccaatatcagaggtttcagggcaccgaaccacatgcctctcctatgaagttggtttacaagggaaataaatggcgccacccacttgggcccctagtcacatcaaggatataaaaaggggtctgagagagtggagggctgcgggaccctgggagtcagtttcttcggagagagctgctgctgtgctgtttccaggaccccagccttcccttgcaggaggttctggcaaggcttgtggcaggcacataccaccttctaactctgggcaggccaagggggcttccagaacttctcagagagctttaagatgttggagacacagagaactgggcctccaggatccaagaaagctcaagtggatgagcgagtgtgatctgactcccgccctgggaacccagaggaagggttgcaggccagctgcactgggggtggctgcagagggcactgctgtcagggcatgaccccacccagagtaggtggggcaagtgctccaactgtttcttatgggccagaggtgggcaggcgaagagagagccagtgtgcaccactgtgacagggccacctggagggacaaggggtcttgccaggaagggctaggctcatggttcccatgggcaaaggaagacatcataagggggtacccagaagagagagcccacaaaaatgccttgtgtgagagcatccctaaccatctgcctggcctggggaggagaagccaccagccaccctgtctctgacaagtcatgggatcgaatgctctcctggcctggctgagtctgtgtttataacacaaactgactgattaggtaaaataacctaagactgagctgcaaagctacaggatctgcccgggttttctccagggccagggaagatgatcgccactgaataaagctaaagagacaggaagggacagagacaaaggctgggttatattacatcagggattgtgtttgttcacataatgactttgcaggtatttgcaaggagtgtggagggctgtggcagggaagcatcaagagtggggcacatggtggggaggggaccgggctgtgtcaggggaggttcccagaggaaggggcattcagggaggtctgaaggctgagtggaaaggagaagagtgttctggcaaggctgggaggaggaggagcctggagcctttgaggggttggaagagatgctgttacagaggttggcaggactggggagacctctgaggggtttgccttgatcctgaggcaatagaaagccactgtgcagtcttatccagagggtaattatcttggatgaaaatatcactctggtagctgagtggagaagagtttggaatggatgaggttagaggaaggagcttccctggtggcctccatgaggcgatatgctggcctcacccaaggaagggacaataagatggagccaaaaggtgggatttgaaagacacgaaggaggtggagccaatggggcttggaccaggtgaggggtgagaggtgagggctgcatgcggctgaggatggatttgtgggaccaccttcacagataggctcagggtgaggcagaggagctcagagttggctgggctgggcctgaaagctctggagatgtccaaagtaagcagctgaatctgctggcctggggatccaaggagagacctggcctcaggaaaagatcaagactcttcaaagccataggaggggaaaagaacgtgttttccactctttctgggagagagcacagggcctaaagaacttgaacattagtcagacaccagaggatgttctgccaggggaggctgaaaaggcacagtcaataagatgggaggagacacaggcaacaaaataaaaaatagacaatggagttcatgaaaattaaagttttgtgcatcccaagacattatcaacagagtaaaaaggcaacccacagaatggggaaaaatatgtgcaaatcatatatgtgataaagaattaatatccagaatatatagagaacttctaaaagtcaacgacaaagaaaacaaccaaattcaaaggacctgaatagacgtttctccaaagaagaaatacaaatgacgaataagcacatgaaaagatattcagcataactgatcattagggaaatgcagatcaaaactacaatgaggccgggcacagtggctcacacctgtaatcccagcactttgggaggccaaagtgggcagatcacctgaggtcaggagttcgagaccagcctggccaagatggtgaaaccccatctctactaaaaacacaaaaattagctggtggtggctggtgcctgtagttccagctactcgggaagctgaggcaggagaatcacttgaaccggggaggtggaggttgcagtgagctgagatcgtgccattgcactctagcctgggcgacagagtgggactccatctcaaaaaacaaaaagcaaacaaacaaacaaaaaaactacaatgagataccatctcagacagattaggatgactgctatttgaaaaaaacagaaaataacaagagttgatgaggatgtagacaaactggaacccttgtgctgtgggagacagtatggcagttcctaaaaaaattaaaaataaaattgccatatgaaacagcaattccacttctgggtacctacccaaaagaattcaaggcaaggtctcagatatttgtgcactcatgttcacagtagcattatttacaatagctaaaatgtggaagcaacggaagtgtccctcagtgggtgagaggacaagcaaaatacatacaatggaatattattcagccttaaaaaggatgtaaattctgaaaatttatgaaaaaaattaagaaaaaattctgaaaatcctgaaaaaaattcctaaaaaggaaggaaatatgttgtgacctggatgaactttgaggacattatggtaagtgaaataagccagtcacaagaggacaaatattgtatgattccacttatataaggcacttagggtagtcaaatttgtcaaatattatatgattccacttatataaggcatttagggtagttgaatttgtcaaatattgtatgattccacttatataaggcacttagagtagtcaaatttgtagggatgaaaaagcagaatggcagctccctggggctgggggaaggcaggagtggggagttagtgtttaatgggtgcagggtggtaatttgggctgacagaaaagttcttgacatggacggtggtgatggtggtaccacagtgtgcatgtgcttactgctacagaattgtacgcttaaaccatggttatgatggtcagtgttatgctctctcagcaagttccccagacttgctcaggagaaggccatctcccaggccctcggtcctctgctaccactcttgtcaaatctcagcacaaggacagagcctagaccagg

SEQ ID NO: 263 - DNA, 3612 bp, Homo sapien
catattggtaaaggcattagggcgaaggtggaacggaacttcctgttctcgcgggatctaaaggcgggactgccacgtccaagcaaaccgggaaaggagaggatcccggagccggtgagaattctctgttttttctctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgtgagtctccaggggatgggagagagaagggctggttctggattgttgggaaactccacagtacttgaccttgactctccctcaccaggcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttggtaagtaacctctgacttctacctcaaatctaacctatttcgttctttggaggaaaagggttctttctcctttatgatccctgacctttcgatattcccccaaatacacactcattgtgtcagatattccctcatctggttttccccccttcttccagaacctcattctcaccacactctggagcaacccggacatggacactcccacagtggtgaggaagagacagatggggatgggagttggggtgctggggaaggtccgtctctccctattcctcacctcccgcacttgaggaggaggagtctggaatgcacatctcccttaatgtctcaatgcctccattcccaggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaaggtgagcccaggaacaactttcctgaaagctgacttgcctgcctcagaatctcctcatcttatggccctcaggagggagaggacatgttggaagatctgttctccactctgaccaactcttttcttccctcagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttaggtaagggccagagttggtgataaatttgggcaagggacatcatcacaaatcacatggaatatgtgctgtgggtaatggcaggtatctgagaaacactaaaggactgggtgtaaagtggtctctgaggggaggtgtgagaatagctgaccaagactggaacaagtggtgatggaagcctctgatcattttctcttcttgtcctgtacaagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggttggtgatgtctgccaaacacagctgcctcaaaccctttatctctcctcactcaccctaaacccaaacagcctcttattagttccaaacaattcatactgtcattgacaagtcctctagaaatgagggggaagaagttctggttactttgtcctttagctcagtatttcttaaactggtctataaaccatctgaatggtttagtggagtcttacacacacacgcctactcaatcagaaagtctgtggaaaggacctctgatctcttaagatttttcagaaattgtctattctagactgctccctcttctctttttattttgatgtttagtttccaaatccatgtcccctatacctataccccaccagccacttctaaaccactgataatctttagctattggtgagtgcctttttctcttttctgcccatcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccc

SEQ ID NO: 264 - DNA, 10000 bp, Homo sapien
gataaacacacaacactagtgggagaattcaacaccccacagacagcattagacagatgatcaagacagaaaactgacaaaggtactcagaatctgaactaaacacttgaccaaatgaacctaatagaccaccacagaacagttcaccccaaaagaacagaacacacattcttctcatctgtacatggcatgtaatctaaaatgaaccacacaatctaacataaaacaattcctagcaaatacaaaacaacaaaaaatataccagtcacgttcttggaccacagccctataaaaatgtaagtaaatactaagacaatagcttaaaaccatataattacatggaaattaaacaaccctctcctgaatgaattttgggtacatatgaaattaaggcagaaaccaagaaattctttgaaactaatgagaaaaaagatacaacataccagaatttctgggatatagctaaggcagtgttaagaggaaagtttgtagcactaaatgcccacattgaaaagttagaaagatctcaaattaacaacctaacatcccaacaaaaagacctagacaaccatgagcaaaccaatgccaaagctaacagaagacaaggaataaccaacatcagagctgaagtgaaggaaattgcaatgcataaaatcatacaaaagatcagtgggctgaggagttttttttttttaaattaagatagatagaacactagccacaatgataaagaaaaaagagagaatatacaaatgaacactttcagaaatgacaaaggggacattaccactgaccccactgaaatgcaaacaaccttcacaaactactatcaacacctctatgcatacaagctagaaaacctagaagaaatgcataaattcccgggcatatacaacctccaagactgaactaagaagaaattgcatccctaaataaaccgatgatgagttccaaaattgaatcagtaataagaagcctgccaaccaaaaaaagcccaggaccagacagattcacagctgaattctatcaaatgtataacaaagcactggtatgatttatacagaacctattctaagaaactgaggaaaagggactcctccataactcattctataaagccagcagcaccctaatacctaaacttttcagagacacaacaaaaaatagaaaacttcagaccaatatccttaataaacacagatgaaaaagtactcaaaaaatactagcaaactgaatccagcagcacatcaaaaagctaatccaccataatcaagtaggctttatcactaacatacaaggttgtttcagcatatgcagatcaataagtgtgcttcatcacataagcagaactaattaacgaaaatcgcattatcatctcgatagatgcagaaaaggctttcaataaattcaacatctcttcatattaaaaactctcaacaaactaggaattgaaggtatatacttcacaataataagcaccacctatgacaaacaaagccacatcataccgaatgagcaaaactggaagtattcccctggaagataggaacaagacaaggatatcttccctcaccactcttaatcaattactggaagtcctggccaaagcaatcaggcaacagaaagaaataaaagtcatctaagtaggaagagaagaagtcaaactatccctgtttgcagacaatgtaatcctatacctagaaatcccaacagtatttgcccaaaatctccttgatcttacaaacaaactcagcaaattctcaggatacaaaaatcaatgtacaaaaattagtaacattcctatatatcaacaacatccaaacagagacaaataaagaaagcaatccctttcacaatagcagcaaaggaatacaacatatagaggaatacagctgaccagggaggtgaaatatcgctacaaagagtattacaaaacattgctcacagaaatcaaatatgacacagacaagtggaaaaagattccgagctcatggatagaaagaatcaatactgctaaaatgcccatgctgcctaaagcaatttacagattcagtgctatttctgacaaactaccagtgacattcttcaccaaagtagaaaaaaactattttaaagttcatatggaataaaaaaaaaaaaaaaagaaagagcccaaatagccatggcaatcccaaggaaaaagaacaagctggaggcacattacctaactttgaaccacactgcaaggcaacagtaaccaaagcagcatggcaatggtacaaaaacaggcacatagaccaaggaaatggaatagagagcccagaaataatgccacccacctacagccatctgatcttcaacaaagttaagaaaaacaagcaatggggacagaccccctattcaacaaataatgctgagataactggctagtcacatgcagaagattcaaactggatactttcctaatacatatacaaaaatcaaagcaagctggattaaatactaaaatgtaaaacctaaaactgtaaaaagaaaaataacacctgaaaaataacctaggaaatacctttctggacataggacctggcaaagagttcatgacaaagatgccaaaagcaattgcaacaaaaacagaaattgataaatgaaacttaattaaactaaagagtttctgcacaagaaaataaattatcaacagagtaaacagacaacctgcagaatgggagaaaatattttgctaactatgcatctgacaaagtcctattcagaatctataaggaacttgattttgcgagcaaaaaacaaacacctccatttaaaaatgaataaaaggcatagacaattttcaagtgaagacatacacacagccaacaagcatatgaaaaaatgctcaatatgaatgaatcattaaagaaatgcaaatcaaaaccacaatgagataacctctcacacccctcagaatgcctattacaaaacaaacaaacaaacaaacaaacaaaaacagactctgtcaaggttgtgatgaaagggaatgcttttatactgctggtgggaatgtaaaacagaaacagcaaagcaagtaccacatgttctcacttacaagtgggagctaaacattaaatacatatggacacaaagaagggagctacagacaccagggcccacttgaagacggagggcaggaggggggtgaggatcaaaaagttacctatcaggtactctgcttatcaccccagtgatgaaataatctatacagcaagttcccatgccatgcaatttacttatataacaaacctgcacatatacctctgaacctaaaataaaatctaaaaaaaatttaaaactgcagagagaagtgagatttctctttaaataaggcaggattgatttagtgatttagtgatatttgaggagtggtagtgtttagtgttgatatctgagaaagagcattccaagaagaaaggacacaagtatgaagtccctgaggcaatgcttggcatattcaagaagtgacacaaaggccaatgttgctagcatgggatgagccaggtgtgttttaggacagacaggcagacaaaaacagatcattcaaatgattataggacttcgtaaggattttggccttactctgaatgagttgagaagccactgaaaaatctggagcagaagaacagcatgatcaaatttgcacttttgcaggctctctctggctgctacattgagaatacatcaggggaatgtgcagaactagaaaaaattattaggagttgatagcaattatcttggcaagaaatgcagaaatttagatgagtatggcagaagtgacgacaagggattggattctgtatgtttttgaagacagagtctataaaatttgctgagatgagatgtgaaggagagaaaacgtggactctatgttttttgtctaaatatctgaaagtctgaagtcttcattaacaaaaggaaagactgtaggagaaacagatttggggatggaaggaaagatgagtaatttggtttagacaacttagttctaagttcttgtcagacatccaaatgaagatgtcaaatatgctattagagaaaggattctggagaccagggttgggttctgagctgaaggattaaatgttcacatcatcagcacacagaaagtaaggccatgaccagatgaacttacctaaaaagtaagagccaaaagagaaagaaaaaacataaatttagacccttattttataccacacacaaaaattaactcataattcattgatcatggagcaaaaacttaagaactatgattactgcgatactgagacactaactgtaccaaatgcaagaaataaaaaatgggttaatcaatcataattctatctatgtatttctttacttagatcattatgtccataatgattatcccctgcctatcaatctatcaatatttacattgctattttaaataaaactaaattagatactgagtcactatcactctgaataggcagaaactcaagtgaaaacattattgatcctcccacattctccctagatttttggtcatgttacttttaaatgtaactgacatttgaagaaaaaagctttatataatgagaaatatgtaaatagatgtacataaataaataatatatataaatacatatgaataatcagccttattcctctctattgaaccatttggctacattatcagtaaggagactccatgagatcaccaacaaaacaagcccgattgattaaaggttgaagaactgagaccttgggcagtgtgatattttcaatttagagacaagagagaactagcaaaggagactgagaagtggtgcccagtaaataaggaaaaaatcaggagagggcagcatcctggaatgcaaataaactatattcagtactgctcacagagcatgcaacatgaagaccgaccattggcaacacagactccctggtgatcttccaaatgtcagattcaatgaagtggtgacaacagccttattgaaatgggttgataggccaatagttgaagaggcttcatactttgctaaataattataaaccaagagggggaaagagttgaaaaagctgattcctgaggtcagcctttaacattgaaaatggaaaaccctcagccagttctcagggctgagccaattcagagaagcagaattcaatgattgaagggaatcttaagtcctcttgatgatggacattgaaaatgcactgcaagaacactcaggatgtatcatatgttgctttctcaaagacctgtagctattccccagaaaacagtcctcagagaacagaacacacgtccatattatctgagacttttaagtttggagcctgaactaacactaatatctgggtaccccaaaagacacagtggtccatgggatacggtggcaaatttttacttctggatttttttttttttttttttgaggtggagactcgctctgtcgcccaggctggagttcagtggcatgatctcagctcactgcaacctctgcctcccgggttcaagtgattctcatgcctcagcctcccaagtggcttggattacaggtgcaacaccaccacacctggctaatttttgtatttttagtagaggtggggtttcaccatgttggccaggctgatctcgaactcctgacctcaagtgatccaaccactcagccacccaaagtgctgggattacaggcatgagccaccgcaccaggccctttttgggcttttgtttgttgtttttgtttgtttctttttagagacaagatcttgcttgattgcccaggctggagtgcaatgacaccatcatagctcactgcaaactcgaattcctgggctaaagcaatcctcctgcctgagtcttctgggtagctgtaactacaggcacacactaccacaaacaactaatttttttttttttttttacagattcttactatgttgccaaggctgatctgaaactctcagcctaaagtgatcctcccacttcggcctcctaaattattaggattacaggtatgagctgcctcaataggactggagtatgagtttttgaagatcagatggtacatagagctttggcccatgtccaacccaaaggggttctaatgagttcatcgtagttaccccttcctgaaagtgtaattgaagttgacaggttcaacagctgtcaggactcttacatttcttcctgacctgtataccaagggacattattgtaagcaggaccaaggggaggcttctgaaattctactttcctggcaataaaatgaataaaacataataactgcattctccaggaaacagaattggtcgctgccacaacaaaaaactcaaaagttccagggggcggtcgtccattttatatctttattcagttaacctaactggcctctgtcaaaaccagatggattataggatgaatgcacattagcataaacttaagtcacacttgcacattcgctctaggatgtggtatcttcactgagcagaatgtggtttccagcactttgtatgcggcttttgatttagctaatgctttttaatctacacacattgtggaggaaaatcaaaacaatttgctttggtgtggtaaaaacaagaacactgcttcactgttttctgtcagggctgtcacttctgctttcagtttaattgacattttgcaaaacatcatgttaattcaatatattaataatattacataaagtggtacccataagcaggaagtggcaagttccttaagtatagtaaaatattataacattgaacagaagtaaaatactggaagaagagacataaacttcagcagattcaaagacctataacatagatgaagtttataggggtccaatgcttctggtccttttgtcaaaacatcctttttacagtaaatggcatgttgccctatatatatatatttcctatcactaaaagggaaatacagttttatgggggcttattggggttttgaattcaacatataccacatttaaggatatttctctgactcactaaaggagtttgcaagggctgcttgtctcaagtcaaacccgaaacaaaaacgggctctatagcagatatagagtctggcccaagttgcttggccattgtgccagatgatgtaacagaattcaaagttgctacaggcatgcatagtgggcattataggactctgtgcatgcctctcacaagcccataggagtggggagagcaaactcctagcgaattagtggaagactattccttctccagcagaggactaccttctgtctgaaaaacaaaacagcaagtgcagaagattaatccaagcataaagcccctctaagcataagcacttctaagcacaagaccctgtgcaactgtgaagtcatatgcctataaagccagccatgattggagggcatgagccaatctgagttgcacaaggagtggacagtattgcccacaaacatatccttcctcagattatcttgactgtcttctcttttcttggtcagcaccttgcttgatccagatcatccttccatttgggacttcaatggaacaccacactgggggcatgaggtttggctttcataactaccaccaagggactggatgatggaacgcagaacagcagagatggtagttctgcctcagggaaaccctggccaatgggaaatagaagacagaagacagctgagcagatacattttctcttctctttctcttccgtggactaatgccggctgtggtttccccttgcagcccttctggaaaagtactgggagtcaagtccacgcatctgatgaccaccatgctgtctctctcatctcattgtgaagtggtcatcagcagagtcatatcatacatcacaagacatggtttcacatttgctttgcctcaatttccacatgtcctggccattgctgccctggacttatcttccaaataaatgttatcactttaacatcagacattggctctagttctagacacccaaggctaagatactcgtttagtgttataattgttatttatgcatttttctgtgggtttttaatatggcaatttaaatgttcatttagaaagggttttaaaatattctataaaagtcacgttttagtaaggtagttggtaactaactcagttttttttaatgaaatgccatttttgtttatacactaaccagctggaaatatcacaatacaaatatatcattcacaactgaaaaattgtatgcaaagata[450 bp omitted]acaaataactaaatcagatgtagagatgatttgtcccaaggtttagataatattgttaaaatttcataactccaagaattaatacagtttatagaatttaattgtttaatgatgttatacattttcttcctataatagaacttgctattactgaatatatcaacacactgtctcattgtattatttgcaactagattataatacaacatatattttagatgttttctatcattaatacatagatttcatagatgccattttaacatttgcaaaaagtttaattcaaatgatttttataatttctatactatttttacatagagtatttttctaaggtagggaagactcaagttcttttatgtgaagtttaaaaagaatttcaagtatggaagatagaggagatcattggcaattcagggactctgaggtggtttagaaaaaaaaaacctgaaatacttgacatcagatctcaacttcaaaaaaggttttctttaactcaaaaactggaagaaatgacttttctaactgcatgttgagacttatgacaacataagtcatcacggtgtttctttcttcatccttattatagaaatgacttttttctcaaatgttcacatatttgtattaagtctattattcctcagtactgtttatggtagacatatacaaaatgtgttctaaatatatttgtcatccttgaatattattctgtgcatctttttctgaaaataattatgctggctataaactaaacataaaattagaattcatgatgaaataaaaactaccccaaagatgaaacctcattattgatttagaattgagtgtgcttactatcaaaaaatttagatgtttaagcacactgtggtacatatgtgtggtaaaaatcagtggaaaagagcaaagattttgagataatgtgtcacttcttaacaattataagtaaagatcacacagttttcaagtgaaacatgataatatgaaatgtatatgtgaaatatacatgggttcatgattctgaaaaacttcttaccatattttctataatttggcatcttgtgaaaatatgattaacattatgttattgtcaatgtcttttaagtctttcatatacagatgcacacacatagatacacttttagactaactttaggtaaaagacttttctaggtatgctttcagaaaatactcaaaaacatacactacagaaaaaacagtaaaaagtataaaatgttccagacactatcagtttgttttctcctagaatacacacacaatgtcccacttgtgaatctagagagttgagagtttcaggtctttta

SEQ ID NO: 265 - DNA, 10000 bp, Homo sapien
gatcatgggaccgggtgagcgctgagaatcgcggccgcagccatcagccctggagatgaccaggagcggccactgctgagaactatgtggagagaggctgcggtgagtgctagcgcgggacgccgggcctgggaggcccccttgggaagggggaggtgggaggcctgaagagggaggaagcggcaggatcacaagagggtcgctgcgtgggaaagatccacctccctcggggaaccgggaccgcgggagcccgcgtccttccctccccctctcctactgctggctcgtcacaaactcagccagcgcccccccaccctcgttacctcctctttctctccctacctccctcgctcagcagctcccggtcgcacaactcccagcagccggcgctggggaggtggtagggggtgcgggtggaggtgcccagttagcttctcgtgggtggccaacctggggctcccattctcctgtgcaccctggagtggagctcccgctatcagccacaggggctgaggatccgcactgggggcgtcgtgggcatcgggcttcagcttcccccctcttgtctagcccccctgggcgcataggggggcttgtgagcactgcagactgcagccttcccctcaaccctccctcccctcgttggtgggctgaccctgcctctccttctctcctccgccccgttagagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacaggtacgtcccagagggagatcagggctccttgggccagggaggagggagactcgaccggagggagagcgggagagggatcaggctagagagggagagggaaagcgggagggagcccagcggcgaagtgcaggaggggcaccagggggcgctgcggctccgcgctccgcggcgcttacccaggaacgtcgaggcctcttggagttcgcctcaacttcccccggctccagcagcgtccgtcccgagaggcgcgcgtcagggcacgcgtgcacgaccgtgctggtatttgcaggtacgcagggctgtgcacctgccgcagttcatgcgtgtgcaccacctgaggacatgtgaggactccggctggccgtgggcaccgctacagcagtctgaggaagtgcgcagaaaagcgcgcgtgcctatgagcgtgtgcggcccactgcccacgtgcacctaggacttggcaacagcgcccgcagtagaaaggctagggaggggctgtacagtccacgtccgtctgggagcttcttgggagcctacctttccccctacgcacgttctttgccagctcctacgcgctggcccgcggggggacgcgcctactctccagaattcagcattgcacacggcgcgcgtgagagagggtgtgtgtgtgtgaacatgtgtgtgtgcgtgtgtgtgtgcacgtgtgtgtgcacgcgcgcgtgtaggggtgggtgaaggactctccacggccccttggctcgaggtggggcgagccccaagttccccaggcacagcggagcctgggcccaccaggcagcgtcctcactcccaagcacttggggtgtactctgactgagaggagccgggtctgtagttggggctgggcgtagagcaaagtgtgtggtgcacacgacgggctcgtagggggcggggtcagccaactagctgagctctcaagctgggacgcggggtctgggtgccgcctccgcacgccctgcggggtctgtagttcgctccgcgccagcagggggcggggttgataacttggtcctctctatcccaggtgggaggggttggatggagggtttattctgtgcacctaggagcttggtggggtacagaacacgcgcggcgcttagggtctgtggcccgcggcgaacttggggaatgcggtgggggatatggacagagatggggatggggaagtgcctggagacaggggatgaggaagctggatgcgagaaggggctgggggatggagaattagctcgaattggagttgtggatagagttagagatggatcgagggatgtggatggcgtcggggactcggaatggagtccgtgatcccagcagcctatcctgctgctgagttccatgcctggctcctagagcaggaagccaagttggtaatccctttcttctggtcgccttgctcaccgcggccctgcctctcactcttcaccttgcagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggtaaggccggaaactgatgccctgccaggacctgggaagccaccagctgcatggcagctgctgcaggtcttcggacgcccctagaatctgtcttgatgtgaagtgggggtgggggtgggagggtcgtggccactggccctggtgagaaccaggtcttgcctctccaacccagaaatgaatggaaatgccttttgccttgtttctgaaaatggtgtacacaggagcactttggtgtgtgtgtgccaggaagcgctcagaaaactgagaagtaggctgtggggtggtggtggtggcggtggtggcatgtttggagatttacgagtaccatggggcacagaggtgggcccaggagcactggagacatatgcttcctattttcacaatgccagttttacctgattgttttgtgggaaaatgtccattttttcctcttatggtaagtgactaaaactatttctaaaaattattaaatgtgggtaggttctggaagaaaatgcaaagtttttaggtaaagcacaaaagggcagaaaaaatgtcatgcttcctctgactctgcagttagaggaacagaggtggggagtttgagaagccctgggccagaggagcggaggagagacccgttcctcaaggggagtgggtgggagtggaaagaattaactccaaacccagagcatggagggcctggcattttccttacgtgttctttgtctggggctccaaggccctcagatgaaggagttggctcctgaacaaagatgggtcttggtactaaagttggagagtctcaaaatgcaagaaagagtgtacaaaaatcagttggctctgaatgagagggagggtcttttttgtggacagcctgggagctttggtttggagaagaagggagagagatttgaagatttgaaggcgatgttatgacagcctggtttgggaattacacagaagtggagggaaggaagaaggctggaatgaagaagtaaagtgaggaatgagaaaaaagggaaagattggagttgtgtgtgtactgtcctctaagtcctgagaaaagattgggagttcagaaggcgaggaaagagtaagtgtacttgtgtgccatagcctctagccctgagaccttcttggagagtgttccttagatggcaggagatattctagtggagtgagcagacattcactgtagcgctttccttttgatgctctcaaagcacttttatattcatcacatcagcttttgcttctgtttcagcgattcctaccagctcctttggtaaccgtattaattctttcaggtctcctgggctgcagcacattcagctgtagcacacaattgatgcagtgtcttattaaacattcattttaaatgatttgcaggctagcagaattcctgtgtgtagctgagcattttcccagtcacttctcagttttggggggctcctgtctgggaagaagagagtagggactagccatgctctgccaccactgacaatttcagaactggagagcatcttagggtttcttggagcatgctgtaactttcagatgaagtgactgagccataggggagttaagggaatttgccaagaccacatagtggctgatgtagctaggtagctgaatttctgatcccaaggtgtgatcttccattccactaaatcaagcccatactttaatgatgtcatccatcttcaggagggacaagggatcagtttcattttgtgggaggggctgagcatggagagctatgatgaatcacagcctagagggcttttgtatgggaggggccaatcttctaaagaaggcattgagggagaagaacagccagtttccagccacgccttggagtatgattttgggatttaaatattaccacggatcccttcttccttcttgagtttttctaaaggagtgatagactggaaacagtaaccatactgaaagtgaaatttctggatccatgagggtttggcacaacccaatggagaaatctgggaaaagctgaattggaaaaggtggtgtgagactgggaggttccgggtaggctttggctcttacttctaagtctcagtcgataggtgtgtggctcaggctgtcatgtgactcattcatccgaacgtaggcagagagaagccggaagagtgtagggtcatggaagggaacccccttgataggcagtgaccctgcctgctagtgaatcttgacccagtgaatggcaggttgtgaccaactagaccagcaactgttcttcccttgaagggggcattagaaagaaagttttgagaagtccagggagtatgggtggaaacattcttctctcctttgggatgaaactgcgttttggggatgtggaccaaaatgtgacctcacttaagagtaagaagagaaaaggaatcaggaaagggcaagaggaagatgagaaaagacatttccagagaaataaagaatagagacttaagaggggttggagagaagaagaatgaaagggtccattggttcaaaaatggaggaggggattcgatactcctgattgttgttgggactttcagagttggtcttggagacattggccactctctgtgattctggtggaactgtagggagatgaggcaaggtggcagggaagcaaagagctcagtggaggtaacatcggggtatatgtctggtccccatgtggaacggtgatattgagaggagttgggtgataccaagagaagttggtttaaaaggtcgtattttgagaaactggggatgtatttagaaaggagattgtctgagaggtgaacagcccttccttccattagtaacatatatagatggcttgtgcttctgccacatgtttcatttagagctgaacattgagtttatttgtctccaaagaaacagtcacggtgcattgtttaaaactctgccttgcctcgcttgcaaatggtattatgactacagcctcaaccttcctagattgacaaggcctctgcctcctgttaaaatgatgttgatttggtaaagtcatccagaacacacgtgtgttatatttacttctacattggcaacatgatagtgcccctgctggtaagaatagtagtcaatttggttatcagttaaaatgaacacacacacacacatttttttaactttttttatttttatttttatttttactttaagttctagggtatatgtgcacaacgtgcaggtttgttacatatgtatacatgtgccatgttggtgtgctgcacccattaactcgtcatttacattaggtatatctcctagtgctatccatcccccctccccccaccccatgacaggccccagtgtgtgatgttccccttcctgtgtccaagtgttctcattgttcaattcccacctatgagtgagaacatgcggtgtttggttttttgtccttgcgttagtttgctgagaatgatggtttccagcttcatccgtgtccctacaaaggacatgaactcatccttttttatggctgcatagtattccatggtgtgtatgtgccacattttccttctgtctgtctacttgaccgttgaagaaaataacaaagccttataacaattgaaatgtcatgcaaatgtggtggatttttgtggtgttaatttaatttacaatggaggtgctaatgttttgctcgcatcattgggtagtcttgcaatataactaaattagaggtgaaaataaggctgagcgaggtggttcacacctgtaatcctagcactttgggaggccaaggcgggtggatcacctgaggtcaggagttcaagaccagcctggccaacatgcttaaaccccatctctacaaaaatacaaaaatcagctggatgtggtggcaggcccctgtaatcccagctactcaggaggctgaggcagggagaattgcatgaacctgggaggtggaggttgcagcaagccaacatcatgccactgcgctctagcctgggtgacagagtgagactttgtctcaaaaaaaaaaaaaaaaaaagaaggaaaattaaaatcaataaataagaggtgaaaataatgctcgatgtagatgaagttctaatcttatcttggcttggccattttgaccctgtctaagtgaaatacactccagctgcagtaatagtccctggtaagcccagaatatgggctagatctttacacttctgctcagtgtccttaaccctctcaccccccatcacttctccccatattcctaattgctccatgcaggaaaagacgaggctcagattttagctatatccatccatgccagttatcacttgggtttcgttttctatgttattcctatgcaagcctcatgtcttctgccagagtgtaagtcgtttgagggcagattttttaaaaaactgtttatctgtatatgtgtatttgacatgacaaatgcttctctcctccgcagacatataaaaataatgccttttcattgtagagcacttaggaaatacattgaaatttaaagaagataaaaatctctctccaaatcctatcaccatgggtaaacattactgacactttggtgtatttccttttatctatttagttgcatgctcaggattttatagtatatatggtttttcttattgtgctttgccctctgtggactttcttagaggattcaagattttctttaattctggagaaaatctcagccgctatctgttggattctttctttccatcattctttctattctctccttctgaatatacatgcatatgtatagtcatgcgttgcttcatggtgggacacgttctgagaaatggatcgttaggtgatttaatcgtgtgaacatcacagagtgcacttacacaaacctaggtggtatagtctgttacacacctaggctatgagctataggctcttgctcctaggctacaagcctctacagcatactctactgtatgaatgctatactaaatattgtaagcaactgtaatacattggtgagtatttgtgtatctaaacatatctaagcacagaaaaggtacagcaaaaacttagaatataatcttatgggaccagcattgtgtacttgtggtccattgttgacctaaacctccttatgcagcacatgactgtactatatatatatatgtaatttctcagtcaattctccatgtatcttgtttttttttttttccagttctctgtttgtgctgtgtttgggaaggtttcttcaattctatactccagttaactacatcatttcatttgtgtctggtctattattttattttagaaagaaacagcatggatggtctattattttgactatctgttgagttatagatttcaacaaggatatactttatttccaagataataattggttcctctttacacctccctgtttttttgtgttataaataatgaaaaactcttctcactttgtgcatgtaactccctcccctgtcccttcaaagattaaaaaatatgtattataaagttcttctctgattgctctagcatctttccttcttcagttgtgaagtccttcatttgtagaatcagttagttggatgttcacatatgttctttaatttttgtttgtgaacttattttcaaggcaactttatgatttcttatgccctgtatctgtgagggtgtgtattttaagccagagcccatgtcagcagctcaggtttgtactctcttcccattctacgtggcctgtggtacaggcttaggagtccatctcatgtaggtgacttcattttggctccttgacacagatagggtcctgctttttggctgtgactaatggtggatggtgcagatgttccagcaccatccacagctagcagcctgattctaggtccagttcttcccctttttccctggatggacattgacacctctgttctcatggctcatattggacctatcctccatggattatgtggctttgattcctacttgaaaccctagagtcccgtctttcagttcatttatttttagggattactctctatttttgatctgtgattctcttttcttatttgcaagcaatactatgtaaatttaaaaataactaaaggtttctttaaaaattctatgtcttaggagcagaaaaggaaggttactgagtgtgttcactcggattttgaccccgttttatttcacaacctgcttttatatatttttttaaacttgattatgtattcttggaattttcctttatcactacatagacttcttaaacttgattttcaatggctgcagagtgttcagttcataccacaattattttaacaatttctctctttttccaccattaataatattcatttgtgctccataggggcatccttttcagtacctcacacttgtcctgccctttgcgtttgttacacggtaaatgtttgttgattgaatgaatctagtcattggctccgatgccagcttgttggagcttccggatgaacatatcacaatatggttcagggcattcgtgcagtgtttgttccctcaatgctgactgatttcataggtgtttgccaatttttctcttctctctagtgggcagataattaccagccatcctgaggattagcataaattggggggttacatacgaaaggcctgtagagaactgctgagtaacagctcatcagcaggaggtggaagttggtgctcttgtaacctggcagctccagagtttggatgcgagtgatgggccttcccattaaacactgagagctctcgaaaagggcagacgcacagatcggaatgttggtggagcccactcagctcctgctaaagaggcatcaggtagttcctgggagagtggggagacctatctttagtcttttccatgaggcatgtcagatgcgatcatcaacacctcctcacttaagtcatcagagaccaacaggcgtcctcccggtagcgtgactcacactccaagtagccctcaggggttgctgacaatcgtttgggccctgaagagctgtggtctggtgggtttgcagcggtgtttatcttctttctcatagcctcagatggaaaatgctactgtaggcagagtgagtggggaaagagagagaaagagggctgtgcagaagagaaacaggaactgaatctctggtttgtaatagagagttggtagcctctgataagtcatcacataaatgagacattataaggttattaattggtgtcttttgtttgtcctgcatcccccacccttgatctttcaacttctaattctttgccaacatt

SEQ ID NO: 266 - DNA, 1536 bp, Homo sapien
agtacagctgcttctggtaagcgtgcaggccatggacgccaccctcgatctgggctgacatggtccacttctcaaatttgagctctcctgagtacatcatggagccatgctggttactcgctatgaggtagggcacaaacttctgaatggaccctttgtcctggatggaggccgagacaccctgcacaatattcaccttttccccctcgctgaagtatcgtttctggctgctgctgctcttctccatggcatctagcgagcccatgccccagtacttcttgagctgcaccctgtctgagaagaagtactcgccgctgggcctccgtggtggtggccagcagggagcccatcatcactgtggaggctccaagggccagggccttgaccacgtgccccacggtctggatgccacatcggctatgatggacacaccaaagtgctgagcgtacttggccaccttgtacacagcagtgccctggggctgaccgcaggccatcacttcctgggtgatgcagatagagctgcagcccataactacatgcagtccatccacaccagtgtcaatcaggttcttagcctgggctgctgtcaccacattcctcccaatcacctggaggtggaggtacttctgtttgatgtaatgcaccatggtgatttgatacaccgagttcccttgggaggagtccaagactatgacgttgatgcctacccaggtgagcaggtccaggcagtatttgtcatcctcatgggtgcccacagctgccctgcacagcagctgcttgtgggaatccttggaggccagaatgtagtctcgattcttcttcaggttggtgtgggagacgatggccactagctcatggcgatcattgaccataggcagcttcccttgctaggctgaaggatctcatttgcctgtttcaatgtcatgcctgctggagccaccatcagcttgatccttggcgtcatcacctcactgaggagggtggtgtggtccttctcagcaagaaagttgatgtctcgggaggagatgatgcccaccaacttgctccccatggtgcccatctcagtgatgaggatgcaagagaagccatgccggatcttggcctccagcacatcacccacagtgtgtgaggggctcagcaccacggggtccgtgatgaagccctgttcaaacttcttgaccttatgcacctcgttggcctggaactctggggtgcagttgtggtgaatgaaaccaatacctcccatcagagccatcgcgatggccatgtcggcctctgtctcagtgtccataggggaagagatcagtggtgtcttcagcatgatcttccgggtcagggctgaagttaggtctacctcatcagctatgaaatctatgaaccatgggagaatcaggaagttgttgtgggtgcggcagttggcgccgaggaagagctgctgcacggtgagccagtcctggggcacgtagccggtgccgccactgatcagatggtccgccatgctgccgcaaggccccgcgaagcgacaaacacccgc

SEQ ID NO: 267 - DNA, 476 bp, Homo sapien
caccactgttgatgtcatctatgatgtcacgagggtggcggccatcaacattacggcctacagactgggcagtccccaggatctctttgatggttccagagagttctctggctaaagatcggtgccacatctgtcgagtaatgttgacgatctcatcaaaagtgatattcccattgtgtctaatgtttttctgtttctttctgtctcttggtggttccttgagggctttaatgatcagggcagaggcagaaggcaccacctcaatctgggcctgtctgttctgaatggtcagtttcactgtaatcctcaggcccttccagtcaccccattgccttggcaaggtcattaccaagcttttttggagacagacccagggggccgatcttgggggctagtgcagaagtggcacccccttcaccccgagtgcacctcaggtatacaaatttgatctcgttggggttgaactttggcagcat

SEQ ID NO: 268 - DNA, 8009 bp, Homo sapien
acagcagaaattcagagtctttaattcaaacaaaagaggaaatagatgctgccattcttaggaatatttacaccctgagccacgacatctggactaggcagtaccactcagcgacagaaaagccagctccactcactgagctcagctcatggcaccaaaaattgagagtcagaagctatgtaggacacagccccagagagactgtggaagacaaatcacatacccacagtcctgacaaaaggcaatgtaattacgctgccctcatcaaaaagaatggtgactttgacagcccttttgttaaaaaggcagtgacacaccacagaaaaagcatagatccttgtgtcggccaggcctgactctggcacataggtgggtgactggggccagttcagcagcctcttgggatcaggctcccagtctgttccaaggatgctcattgcatcttctttgcaggaatggatgagaacaggaggcaatatgtgtagggtgtctggcatctagtaggtgcttgacaaatgatggtagctattgctgataatgaaggaggtgggtgggtgacacaggctggcagagaatccccaatacaccttcacttggctttgtggagatgggtgcagctggtggtctacagatgtacacgtggtgtcctaaatattggcgtcatcctgcaaagttgtttctgatggagcaagtaaaggctgtctaacttctcaccacctgcttacaggtctcgtgtcaccccaccatgctggcaggggatgtaaaacctctcagacagtagctaacttggcctaagcacagaacaaaccagcccctcccctgtcgtctcctgctccttccctctttctagggatgatcacagcttccttagggccaagaaggttataatggcttgtgcctccaaagcctcctgccagccaaaggcagcgaggaaaatgagaagtcgttagtccacatgggacctaaggaaacagggaaggtgactgtgtcaatcagagcttgaaagtaaaagctaaaccacgatgcagacagttgagtgtactacagacagttttaaaactcagggcctgggaacttgggtgtggcagacacctttgggggtggcaaagtcacctcttcttccaagtgctgaggtgggtgaggccatgggtctagcgggtggctttccttgctgggatgctggctggggtgctcttgccctgggtgtccttgaggtctccccctcgcgcctctgtggtcttggtctgcccgctctgggtgctgccagagctgcctgccacagcgctggccccaaggtcaacacccgcagagctggggtggtggtagctgtagctgctactgctgatgacagctgaggaggaggggccaagagcaggggagaggagcagtgtcaatcagcagataacagctatggtaacggctgtccccaagggcttctccacaacaacacctcatttaatccgcagaaccaccctcagtagtcaagaagcactacagagatgaactgagagcctattacgggccggacttcgtgtgaggtgaagaccccataggatagatacagtccctgccctcctggaaatgctaggaaaatccatgtccaccaaccctttctccaaatgacaacgtcccaggggagaaacaggaagggaaaagggtgggcatgacctcagtcaccatttcacaggatgaaaagggagaacatttcctttgaagcccagaaaccttcccaagacagtaacagaagcttcttgggaggtgagacagtaaatggaggtgacatcactttgtcccagggtccctggctttcccaacccaaggcatctctcaagaatactcacagatgctcacagaggatggattctcaccagacatcctgtgagacagaaagttagagaaagataaaaactcagtgtcgagattccactaaacatcaatgggctcctgcttttatacgtgcatcatttaaactcatccttataacaacttacgaaactgacactatcgccttcatcttacagatgagaaaacaagagtcctggagatactagatgatttaccgagaccacaccactagcataggataaagccaataattagcccctgctgaagagccagtcattagccccaggtctgtctgagcccccggttctcatcacagcagcacacggccatctacgcttcatggctcatgtccaacaaccccttgcaggaagctgcctctgagttcacgaaatcaccacatctcttgcttgtattggcactaaccatgttgttctccaggtggcccctcagccagacaggagccacaccccagtcccttctcacactttcccctccaccccacctacctgcactcctcgccctccagcagcttgcggtaggtggcaatctccatgtccagggccagtttcaggctcatgagctcctggtactcgcgcagcatccgcgccagctcctccttggcctggtgcagggcgccctccagctcatccagcttggcctgggcatccttcagggcattgtctccccgctgctcagcgtcagcgatggccgtctccaggctggcacgctgaagggcaaagaacagagagaccatcagaacagaaaattacatttagctcataccagttaagtagaacaatgccctcattttgcagatggggccctaggtgacaaggagtaaaagctgcaaagccaacaccagaactttgtctcttctattttctattgcagaggagtattcaaagctgttatcacatgaagctgtggaagcagttgcatttcaggaggtcaggaagaaatgtcgatgtttgcaaagttagatagtgcctgagaccggaggccaccagtatctacagattcaaaatactacaggttcaggaaaatcatgcccgatcccctagcaaggccagccctgaggatgagacagtatgccacggtcccactgtgatcagattcctgctgcaggacctctccccattggggatccttctgatctgttagcatccagatgagtgtttctggactccagcactctggggagagtctgtgtgaaggctcccacatctggccttcccttagagcaggaggataaggccctaaattataggcacaacctcagaagctggactctgatgaacatctggggggcattgcgatgcctgttgctaacagagagggaggaactatgctcatggaatttgtgaatcggccaaatgtagagtcgtagagttgtccctgtgtttgcctgcagagcatggagggttgtgggggcaccagaaggagaacaggctcagatctttccgctgggcaattctatcactagcagagcagacctggttctcagagaggtcacaggaaggatcctccagcctccaatatcatctccccactgacgcagtgtttaaaatttgctgctgtcaggtaagacaggccccccacccccacccccccgcccactaacatggaagtagtaccatggcacagggcaagggaacccaggagggcttcatcgacagctgtgtccctcagtcaacagaccatgccccactccgagagcaggaacctggtgtggccaacagaggcgcctgatgcataccctctgcaccccacacatgttccatgtccagtgggaggaggagacagagggtctgccctcagagggggcacccaaaggggacatggggcaggttcattggacacagaaaaaatctgcagaaggggaacctgggttctaatcctagctccattcattaccagctgggggctctgggaaagtcccttccccttcccagcccagttgctttatctgcaaaatgaggagtcagagaaataggtttgaggctcctcccagttctgggcggggtaccagctctgatggtagggtaccgaggcagggtgggaaagggagactgtgggtggccgagggacccctaagcccagcaggggatatttgcttgttcccaaagggcaggccccatttcctcatcccagagcctgctgtggagaccgggagttctttgtggggctgctgcccacctgcttcttcacattcccgatctcacaccggatcctctggatgagccggttcagctccaccatctcgctcctggtgtgtttcaggtcgtcaccatgccgactggctgccagctgcagctcctggatctggtttcccagagataggaagttggtgatgagacaagggcactggggaagggtcctgtaaataagccacccctgccaccctggctgtcggtgggatttaacggaactgaagaggagtgctgggacagggtcctgggggcccaggtaaggggttttctccctgacagccccaaagcatagttccattactcagtttacccaaagcatagttccattactcagagcactcctcgccttccatttccttttgaaagtcttcccgtggggatcaggaaagagctacaggcttctccttctctcactcgccccccaccaaattcacccatggctacactcccgcaagtctgtgattctccctctgccctgtggcaacatgcccccattcctataagtgtgtttgttttaccacctcacttctttcacctgcaacagagaggaacaggcagttcgtggatggaggaaagaagtgagggatcctctctgttgcatatattcaatccataccagtttcatgatttatctttgataacaagctctgctaagaattccttttttccttgaagccttggttggaacctttctttcattcagcatgcccacaaaagtattcctcacattcactgtgcaggtgacccctcccaggaagcgaggggctgctgtgggaggagacccattcggtgaccaccttggtctggtacagggcctcggcctcggccttgctcttcagggcgatctcctcataatgcatgcggacctcagcgatgatgctgtcaaggtccaggtcccggttgttgtccatggacaggatgacagaggtctcactggcgtgagtctggatctgagcgatctcctgcattgagagaggaagacagattcagcaaccccctggcttccctcttctgccccatcagtcttctgggcccatggtccctggcccaataggctgctagaatccacggggacaaagtagggggaagaagtgccctctgggatgtgtctgcagagctgagggagagcagctaacagcagcaggaacccctgcatatggcagatgcccgctggcacatgcagacgggtgaataatgcattttccacaatttcacagaatccaaggctctgtgctttgtaagacctcactgggttatcttttcctgcctgtgggcaaggccactattgtatcaagatcaatttcctcctgtatgtatggcctccaaggaccagcatcctgcacttccatggtctcctggtgcagggttttgtacctttctaccaaaacatctttcattttgttgatcctaaatctctccttttggtatctccctggaagagtcgggaaggaggcagggtgagggtggggggacaggagtgtccttactgcatcatacagacacttgaggaacttgatgtctttgtccagtgagtccactttggcctgaagctccaccttgactgcgtaggctgcatctgcatcctgccaagaggccccagagtcattgggggatgcaaccctcatcccacagctgccctgcccaactcctgcctcaaagccacctgattttctattttctacccacaaaggaaagctcactcaatatcaatttcttctcaggctgcctgaagctttgggaatagggaaaggaggatggggcagctctgttatgcctggagaaaacaaagcccagagaggtagtaggtttcctcaggtcacacagcaaggttgagctggacccgagtttcacagttcccagaccagaattctgtctgtctctgtccatttcctgagtgtgtgtctttcctctccaactcactggaggccaggactatgactccaccctcaccaggcaccagccccctcaccaggcaccagccccctccccagcctcctgggctgaagtcctgagcagagttgttaagatgggggtgcgagagaccctaataaggaggctcctccctcccttaccttcttaagcaccacaaactcattctctgctgttgtgcgccggttaatctccacctcatatctgccagcagggagagtagatggccttagcccccttagccaaggaactttctcttcctgctggccaggcaaatgtttgggatacagggtccctgcagggtctctggggtgagcagtaagaggctagtgacaggagtaagatatccctgagttgcttcacttgtctcctagtttttgcatgttaggaaaacacccaggtgcctattgggctcccgacaccagcaactgaacatttcagtgggtcaaggagcacaggaactgcttcctatcaactaggcaggaagttatcatcaaagaggataggcccttccccctagccagagaaagggatgtgagctcctgaccctggagcatactcccccatctcctaaaaaataatggcacagagatcaggtgagcccagaggcacgggaaacatggtctgtgaccctcgggtggagcctgctcacctcttcttatagtcctccaccagatccctcatgcttctcagctccgagtccagcctcaccctgtccccagacagtgtctccagctgcttccgcaggttgctgatgtagccctcaaggatgggctccaggttcttcttgcagttgttcaggtccagctgctgcagcagctcccacttggtttctagaacctggttctgctgctctaggaagcgtacctggaacccaaatcaacagacacctggaaccacaatgggtgcagtcatgccccctggacacacaccattgactccccaggtttgccatagattgttgtagtcatttttgctcatgtcttgactctccacccttgccattccacacaaactagatcctttacaagtgctcatttcctagccttctggacaaggcatcactgagaactcactcaaggagtttccacagctttcttctattgctcggccctggtcccaggagatgtccttccttatgtctcaactaagtgtctcttcctgtaccatgagcccttccctctgaacactgctggattctattagcctttcatgttcttggaagatccagctgtcctcaagaaactcatcacttttttgtcaaggaagggctgctctttacccagcttcccatccttccctgcaaaatcgccaaagaagccgatatattcatgtattcctttgtcctccgtggctcacagacctactctccttccctaatggtgaggaagcccttcctgaggcccagctgcacctttccagccacagtgtgcagtccattcccaggcagcaggaaaactgctcaggcctcagggtgcggcctcatcctcctcctatgagacccaccttgtcaatgaaggaggcgaacttgtcgttcagcaccttgatctgttcccgctcctgggcgcgcaccttctggatctcagggtccagctccacgttgaggggggccaagaggctcttgttgacagtgacctggtggatgcccccaggtgggcacacagacaaacatgcaggccccagggccacactgccaaacatactgccagcaaagccactggcccggccccctccatacccagagccaggcctgaagccgtaacctccagcccgaacgccgccaccagccacattgaaagaaatacgccgattccctccaaggctatagaggctccgactgccaaagccagcgccagcccctctgccagctgcacagtaagaagccaggctacccacagccttccttggcaccactgccgaatgcacactgaagttgcccttgtcaccactggacttgatgttcagttgccgactcatggtgggaaaggttgagttgacagagctggagaaaagcagtctccaagg

SEQ ID NO: 269 - DNA, 977 bp, Homo sapien
atttctttgttttgcaaataaagctggctgagttggttgccttttggtgattagtcaaataggccaaatcccatattctcatccaactcctccaactcttcttggcttcagccttggctggagctgcagcaggagcagcagtggtggcagtggccccaggggcagcagccacaaaggcagatggatcggccaagaaggccttgaccttttcagcaagtgggaaggtgcaatcagtttccacagacaaagccaggacttgcttgtacccattgatggtagaatgaggtactgatgcaacagttgggtaaccaatctgcaggcaaacactggcaacattgcggacaccctccaggaggtgagaatgcagtttcctatgtgatgtcaagcacttcagggttgtagatactgctactgtcaaacagctgctggataatcatcccaaaggagaagggagagatgttcattcagcatgttcagcagtgtggcttcactggctcccactttgtcaccagtcttgatcagctgcacatcactcaggatttcagtggtgatgcttaaagcctggaaaaaggaggtcttcttaggctccagaccggtgttctggcctgggacagtgacttcacatggggcaatggcaccagcatgggtggcagctggcaccttactattcagcagcatgtccctgaacttagtgaggtcttccttggtgaacgcaaagcccacatttccctggatatgaggcaacagtttttccagagctgggttgttttccaggtgcccttggatggccttgcacatcatggtgttcttgcccattggcaccatggctttccctcagagggacatgtggatctgctgcatctacttggagcccacattgctgcttctacaatgaaacatttcagataatgattgaaaaattggatgatctgaaggaagtagttggacttccaggttgccctgtattccctgggcag

SEQ ID NO: 270 - DNA, 10000 bp, Homo sapien
ctcagacggtttcggtgcttctcccactcggatgttcccgcggcttaaaagagtccgcagcgagcaccgaaatacctcttccagggcgggttttcgggggtgtgtatgtgtgtgctggtgtggggagggcagcggaaagaagagctattttggaaaaaaaaaaaaagtcatggttctgtagcaccggtaggatacctttaacaaatgagggagaggtggggggagagaaggagaaggaggaggaggaggaaggtgggggggcggggggtgtggagaggctggtgcaaaaggaatgcgcgtttgcaggaggaggagtaaagcgatgattgtgtaattaaataataaaacaatccttaagtctgatttggagagagctcgagcggggtccagagggtggaaccggtgaatttttcaacttccaagttttgcaacgaaagaaagcaagagagggagggaaaaaaaagagcctagagcagaaaagagaggagtttggagccgagcgggagagcgggatttatcgtttggaatttttcaggagatcgttttgatacccctgggctctgggcagcggcggcaacagcagcctccacgctcggccgggtcagacgcggggcgaggcgggcgggcgggcggccgggcgccgaagacccggcgcgggcggcggcggctgctgctgccggggaccacgcgccgcgagcctcttccgccccagagatcagcgctcgcgccccctccctcaccccggcctctcccttctcccccatcccaccccgcccccaccccggccctctcccgcgcgcgccccgccacccgcgcgcactcgctcacgctgcccctcgcgcacacacatggtcggctcgcggcaaagtttcgcctgcgatcaccactccgggatcctgccgcagtgcttggggctgtaaccttgaactttcccagcgcggtgacacattctccccgctctccctcccgcccgcccgctcgccctcctgcgccctcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggtacatgtctcggtcgctttctcgagctttctctctggcccgaaatgcctttgttttgttttgttgcggacaattagcggcttgagttaacctccgcacatccccgtcccttggagaagtggcccggagttgcagcgggcgtcgcggggcggcgtgggagccgggagcggcccctcgccacggccactgcgagcgcccagccccgcgccctgggcacggagcgcgggcgctgggccgggcaaggccgccggggggtgggcagggccgggacctgtaagtgcgaggccccgtgcggcccctcaagtgcccgttgtggtgcggcatccccgcccggggtgcccgtagcccctctcagcagctcgcgcgttgaggtggactcgggctttggaggactttacgggggactaagcttttaaaaacagccagtgaacttgggcgaggggactgtagcacgagtctgtgtgggcgccgctggactgcgctgcaggcggtgggcgggcgacgaatcgagtcggaggttgtggtccggggacccattcctttgctttatttggggatctgaaaccctggtccatagtgacctgctgcactttggggtttctagtgaccgcaccacaaaggcagtatttacgttgacacgagttagttggtcttggtgattgttaaggagtttttagaacgtgttccttttgtggaaacctgttcatttgacgatatttgggcgtagctcgtaaggcattttaagtaatgctggtagaagtaaggtcatttttttcgactttgagaattgtcctaagaccttaggaataatgttatgaaataaaacactggttttatactttttagaaacacgatttgtatcactttaagccagacggtcaaatagaaaagcggcgagacccaacagacttacctgggggcagttttcatcgctgcccagggaactaacaactgacaaagtaactaaaatatcttagcccagaactgttatttgaggcagtattttaaacctctaaaggtatggggcagcttatttcagcttttcggaagatgtgtcaccattggtaattgataactattttctttgacattgccatgaaaactagtcatataaagaagtgtcagccagtcttgggcgtgttaaaattttaaaaacatctaatatcacgatgatgcatttttataatggacaaataattaagatttcaattgtatgacaattagaagccattgtgattcaaaaggactgaggcattcataaattgtgaatgaagatgaaaacaatgataaggcttattcagtgattggatacagtcctgtagctttttggctgacacattttttattgtttatattttgtttggcatctgagtatgattaacttagatatggctattttcagcaagtaaacacgcactttaatttaacaaaactggaaaaatgagttgctgagctatttgtattttaaaagccatgaatgataatagccaataaatatgatgaaactgtttcaggtataacgaattgcctttacttgtaaaagttaccattaatattacccatcggctggatatatttttctctttctgataagctgtgttaacttgatattatttttacaccgtgatcaaataaaacaaatcaaagcaagattttcacttacagagtatagcatcacttattctcacctgtaaaagattgaataattgtgcatttctctatatttctaacatcagcttttcagaaacattgctagcaattacattgcatttttagtatcctccaaatatgtattgaaaagtcactagttttatcttaatttgtgtaagttaaagataatattgcagcattgagacagggaatgttgggatcatatacagcataatcattcagctatcacattagtattcagagatacacacttaacaacaataacttgtgatgactaatattctctactattttaataatataaatctaggcttatgtattaaaacaaggcctacaccagggaaggaatttcagcttaagaattttcacttcactaagctccatgtgactttgcaggtaatataggtgttataaaagtgaggccacattaatagtgtcacttttgtatcagatcagtagttttgtatcacaagagcctagtagctgtagaaaaacatgtctcaggacatgtaaattgcaaaatagagtatcattcttaattggttataaacttttaaaagtatctcaattgttgcaataaggtatctaggttttagaaaaaaaatcttaatttaaaaggacctaccattaaatgttatgtttagcaaaatagtatgctacaaaatcagcatatcaataaccaatatttatacaccagtataaatcagatataaaggaaaaattaagaactatcatatgatttaatatatgtttaaaaataatgtaaaccattaataatataactttcaattggcatgatggcattaaatatatttttctttcgttgcttttaagttctttaggtacattttttgcatgatttgttgttatatagcaatgcgccaagagcacctagtatttactcttctacctctatgttggtctaaattatccatccctttcatggaaacggaagaaaaataaatatgcctagtggaattaagactctttatttttatatctgaaattggtaactttgttatttactttgtcaatttagttcaactaaaggaagttttaaaagagaattactgaacatcaatgcattttactaaaaattctgaaagagcaaagttgcctattacctttgtatacagttgtttggttttaaatcacttatatgttttgctttttttaaagaatttatgattgcttaatgctattgtaataatccactactagttaggatatttgaaaaccttaatcaccttttaaaaaaatatttttgtatcaggacagttattatgttccatattcatgtcactcataatctttaagactctagtgttactcagcattaggaaacagtcacacttgggagatgacatttaggcatgttaatacagaaatatatgcgacttacagcaaacctcaatttacagtcatttttggaggatatgtccccttgtcaaataagtgcttcacttgaattcacataatagtgaaaccctgaacgatatcaataaggcaaactggcagcctgagaaagtttgctacttttatttctcaaaaaaaagagcatgttttaaaacaatattggcagcattgacagcaaagtcaaaggaacgtttaaaaactgtgtgcatttgctaagaattttcaaattcaaccttcaaatttgaattttggttgtttaaaataactcattaaaattttgagctttcttgtgtgatagattatatttataatcaaatattgaaactcaaatttaatcaaaactgtgtttgatgtctttataagaaaatgaaatgtcactgaacatagtacttaaggtgtaagtacttacgtgttaccacatggcttaatatttataaaataatattgcattttaaaaagcatggcaagggtaaaatgagtgagacagagcccacccactccacctcatgtgctctttacattctcaaggttttagttttgtgagtgcatatatgtgtgttttttagtcatatcaataaatcgtagtaaaagattataggaagtgagtttccaaagcacatttaagtccacatttccttgagcaggctttccttttgcatatattcctaaaggggataaacaaagtttttgtagttacagtgaaagctaaaagcatggcatcagaaagtgtatggagatagggaggtcttatcatgggatgtggttgctgtgagcagggctgccttcccacacaaagaacagattgtggtttaactctttccatggcctagtttaatgtgctcgcatagtaactgaattgttcaaatctctgctggaaactactgatcggtttaatgatttcctctatggcatttgggtatgcctcatgctgtgatgtaatcatcagcattctgtattgttataaaattttgattcatacttattctggtgaaggaacacttacagcaatgttagaacacttgataactacattattgattggatgggacatgtactccttccatatctgaagtgcaaacagctaacatgttgcagtctgtagcattaaaacttcgaatttcttcttcaaaatgtattcatatctatattggatttttgacaccttctttgttaaagagtcattagttgtactttcatcatatttacctaatggaattaattagtcagtctgctgttaaatagaatttattccacgtagttcagggtgattaacatgagtatgtaaattctaacttgggatacaatcagagagttattttgtcgttgggctgacagtatagtcaatatgatcagaaaagtggtggtggtggaagttctcatttgcttcaaatcttggcttattgcgtacatgcggtgtgcatgtacaggacgttaagctctttctctttgaacagtaataggcctaagcttataagacaggttttacctaaatcaggaagtaacgaaactgactgcactgggaagtaacttgaaatatctgtaggtaaagattatccaccattcctcactgatcccctcccttaaaaaaagggcttggatgaaacaggcaggaaaaatgcaggagcctaaaggtaaactacttaattcaaaagattggtactctataatctatgtatctgcaaattcacatgcacatgcatatatgcacccacagttctaactgataattcatctacatggcaaatgaattgtatagattccacaaaagcagtaactgaccagcagtgtcaccccaccacagcatgcagagacacaaagaatgtaaagttggtgccaagttgccatttttcattgttcacctcagattgatttttaagaggtttagaataattgctatactcatgtgatcggtgaacaaattaacggactctgtggggctgcatattctatagggaagctgatggaagaacattcatgtaatttttgttttccagtttgaaaacttctatttaaaaatgcaagagtgtgtgtgagaaagcaggagagtgcaagtgtgtgtgtgtgtgtgttgggagctggcgttggtagtgtggggagagaatgcactgctcaaagtatggaaaccttctgttcaggacactgatacgacgagctgtgtcctttgcccactttccctcactgtataccggtttctctagttaccacttttggaatggtgctgtttcagtgttggaatgttggacgtttgataagaaaatggatcaagtttaatggcgcatgctctttgtgccaccagcagcctcttgctgagagcatgctccaaaagcgggaactgtgtggcattacactgagcatctatatgctttgtgtttctgtgccacagagaagagaaatgaactgtggcatcgctcctgccttctgaacagctctactccgattaaaaaaaaaaaatctcactgtgttctttgtaaaatggtactgcatagtgttagttggtcaatcaaatattgaaatactatattaggtgccaagcaccttagttagttgcctatattttaaagaatgtagaatgcatggcattggggtggaaacaagggggatggggccagagtgtaatacaaaatataaaccttatttcctttataggagggagaattgacctgtgaattttggtggaaaggggacagctgggcatactttactttcttcttgtcctgttattttgataattttaaataagaaaggaatgttattttcatgtataactttttgtactgaattggaaacgggttgtggtcttcttttcttattttttgagcttttaaaattaaactgactatgcacatcttttcctcacccctctgtcttccacaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaaggtaggagcagattgttcttttttctagcacggcaaacaccgcccacaaatctccgtagacagagtatctggcttgagttagatggtcctcaaggcccctagatatcctccaccctctctgggtatagtagggtgtccgctttcactcacatgtccgctgccatgtgcgagccatgtaaatagacacagagctttcgtacctggataggcttggatatttaagaaagaccacaaagaggtgcgttttcaagtatctttaaaataatactgtttttcaaagacatagggtagtctaacaaatatagttcattacactatactttctgtcgtaggctacatttttgcatctaatctagtaatcttttcctgatttgaaaatataactttatttatgaatagccaaaccatcctagataatttttgtattaaccttattaattaatgaggtagagggactttgtttatgaacttagtggtatcgcactgaaaatagaactaatgtttactattacaaaatgcttaagatagataatatcaaaagtatatcttacgtagacctagatttacttaattttaatatttctatcatcacttttgattgtgcaatattcactgtcgattaaatggaattgagttattatttaaattatttatagtatgttcccagagttacttgggaacacttaataatgttagtttacttgtatgtaaattcataaaacttaccgaggaggaaagtcgcagcgctgcttacagaacaaaaaacagaaagtggactggttacactggtttaagataaatcttaaaaagaatacagaaactgcataccatacctattatttaaaatacctgagaaggagaatggtatatattttacctaaataattaaaaaagatgatgttattactgaatatttgagttaatgaaatgtttattatttttatttttcttaatatattttccttaagtaggtaagaatttcttttcttcaaataaatgcatcaagatatagatgtccttgcattaccaacaatccatagtaaaacaatcattttacaaagccgcataccaaaagtagactgaagtttgagctgtcacagatggtaggtcatttccaaacttggcctggtgggaggaaaaatggcctgcagatagccaggtgacagactgttacctgaggtttgttatataaatgtgggacttaataaactgctatgagctttattattcaaaaaaatcaaaattacttttttgactctgaattctaggccctcactatgtgctttttgtcttgattttcttgtagctttggagataggcttaagtgtcattttagaatttttagtctgattttaaataatggtgttggacattgcacttttagaaatattaccttttcctgaaaaaatgaaacattgcatttaatatttccatgcatttaagaattacagtccaaataatgatggtttggggaaaataatatttttgtcccatgtgtcctaaaataaaactcagtaacacatgacacttatttgattgacagatgtctaggaggtgacactttaaggtgggctgtatatatgtgttggattgactataaatgtgttgtaactgtgttgtgaaagtcaaggatggaagtaaagtttcaaaaagtgggtcatgtaactttttagtgcagggagggaagatttgcaaccacttcactactgctcacattttaagttgcttgaaggctaggttttgaggtgtgcctgcctgcatgcacatttactcctggggaaggcagccagctctcttagttttgatgaactgacaataaagatttgtagagatagattgaaaaaagaaaaaaaacgcataaatgccttccatgttgcaccactggtcatgataactataaagttttaagcaactcttaagagaccatggttttagataaaacattgattttgttgttggttcaacaatctctattgtaagaacttttcattattttatcttgtgtatataacttgtatcctctgctacctgc

SEQ ID NO: 271 - DNA, 10000 bp, Homo sapien
cgcattatgctgtcttgcagccactacagatgcccatcatggcttggccttctcaggaaacaggctctccgtctctgcatgtgtccattcacaggctggacaaccgcctgccttgggtgctcccagggaatgtctgtgatgggcagaatgttggaatggacagtccctaagactgctttcaagtccatgacactaccatttgagttttgggaattgacctgaaaatgtgggttctttcaggtagagctctagtattcactaaagagaagtctaggaacttattattttttaagtgaaagcaagtttattaagaaagtaaaggagtaaaagaatggctattccataggcagagctgcccagaagtctaggaacttaggagcaatgtagcaaactaggcatacaaaaaaggtggaaaaaacttctcagtacccttttccagtttcttaagaacctattgtggttactattggtattattgcgttgatattatcactcccacacctcacatttggcaggattcaggggtgtgttgggtggggaagaaaatcttcctgcttgggtccttactctgccaaccagaaactgtgaaatccctacagaaagggactaagtccatatgggtgtgcccagagccatggcagaaagccacctggacatggtcacagaatagattataataacattcaaagcattttcattcattttggcctatgccaagaaagacacaccctcttctcttcctcccaacccctacccaccacacttaacaaaatccacacccccatgagtaattcagccatttatttggcccacaatcagaggtaaagggctgaattgctgacctcactagtacatatccagatcctgaatctacacttaaaagaatgtatggcacaggatttccctcattaccactgagcagcagatgacaaattcattaattaaaagctactttctggctcctggtatgtctgttctttgggaaagaggttacaatctgtggcaaacagtaagttagcttataaaaccggaacccagttctgcagtgtgagctggctctgaacttcttgtccatgaacgtgtagctaaattaagaccacagtgtgaagtgggtgacagtgggatgtaatatcaccttggctctgaggtcatcccatgctcccaagtacccattctgacttgcattaccttgagtcctctttggatggaatttccagtacattcctacccttgtgttccctttccctataaaacgcagcagttcctaatctctcatgtcctctgggccacgctctctgtctctcaagatggctactcattatttagcaattttctcctcttcttcttctactctgtttttccttctccctccttcagcatcatcgcttccatttactaaaccttctctattttcaaatattgtgctgtatgttttgcatatgtgatctcatttgttcatcattctttttatcttcatttttcagatgatggcaataacttgcccaggttaaagctaaggactagagattagattcagactaactttttctgattcctaagcctgataaccatcacactgtaaaagaagacctagaagggaggctacctactacaaagaaatcatgttctttcctgtttatattggatatggtatattgggcagtgtataaaccctcgattcaaatgagaaaaagttatccgatgcaaaagtgaggctttaagtgaagctcactcagcatgctctgaccaggaggaggcaatggaaagagctgacaaaggtgttgtttattgacacctggagccaagagaggtgcgggaaccaaaggagcaggttagagagaaaggaaaacttgcttagagatggtacggtcatctctaagcaagtctttgagatgaatctcaaatgatgaatacagatgaatctttgaatctgagaagaatctgagaagctgtaaggctttttgcctaacgcatggacacctgttagaaagggtttggaataaacatactgagagggattttttctgagccagaaaaaaaaaatctctaaaagttgggcacagtggcacacatctgtagtcggagctactctggaggttgaggtgagagaatctcttgagcccaggaatttgaggccgtagtgtgctatgactgcacctgtgaatagctattgtgctccagcctggacaacatagaaagatcctgtttctaaaaaaatttttttaaatgttcctaggggccaacatagggtgagttttccagcctagaggtgatttacttataaaatataatttatatcaaaatatcatatgtaatatagaaatacattacttataggaaaatgatagaaattggtcctgtattaaattatgttctctcaggtcaagtaacaagggtccattattcactcctctgttcattcatacgtttattcattttattcgtctctgaatatttactgagcactcaccattgacaaagtcccatatctataagaagacatatagtaagtatactctctaaaagaatttttttctttaaagtggtttctttttcttcccatatttatatccgtggcactctgatatccacaaggacgctggttaatattactgcagtaaatatttataggtgaataaaatgaatacacatatgaataaataaacagaggcatgaataacggacccttgttatttgacctagaagaacatgatttaatacaagaccatgtgggagagggcttctaaggctctgaggctcgcttggggaggaaacaggcaaaggtctgtgggaggcctggtcactcctgacctgatggaatgggagttgcattcatttctttttggttctggatttctgaacctgatgctgatctaaaacaaaaaccatggccagggtacaatggctccatgcactggtgttcatgctgtctctatcccagagcagccctgaggttcttaactcactcagagtagaagtcagcttgtcccacctcctgctgctgtggtaccagggcagcatctccagggaaacaccttctgctcatctcctagtgtcttttctgtaagtgtgtggcttaaaaaacactcagtcatctacttcatttaaataccttggacactgtgtggcctaaaagtgccatgtgtcttcagatcttactcaacctcttactccatgtgaggcttggggctgtggaacggctgtgaacctgtttcctcacaggtggaaaggagataatgccacctgcttagcagggttcttgtgagaattaaatgacaatgaaatggaagattctaattagagcacccggcacatagtaggtactctatggtatctgaagattgggtctaaatttcatagaaagacactgaaataatttcatagattaaaacagtgttgtaactgatttcaagctctgagattaaaaatttatcaaattctgtagagaatggcatttttaaagttatactttaccttctgggatacacgtgcagaatgtccacgtttgttacataggtatacatgtgccatggtggtttgctgcacccatcaacctgttatctacattaggtatttctcctaatgcttccctccctttgccccctaccccaacaggccccagtgtgtgatgttcccctccctgtgtccatgtgttctcattgttcaactcccacttatgagtgagaacatgtggtgtttggttttctgttcctgtgttagtttgctgagaataatggtttccagcttcatccatatccctgcaaaggacatgaattcatcctttcttatggctgcatagtattccatcatgtatatgtgccacattttctttatgtagtctatcattgatgggcatttgggttggttccaagtctttgctattgtgaacagtgctgcaataaacatacgtgtgcgtgtgtctttatagtaaaatgatttataatccaatgagcatatacccagtaatgggatcgctgggtcaaatggtatttctggttctagatccttgagggatcaccacactgtcttccacaatggttgaactaatttacaatcccaccaacagtgtaaaagcattcctatttctccacatcctctccagcatctgttgtttcctgactttttaatgatcgccagagaatggctttttctttttttttgggatagggtctcactccagtcgcccaggctgaagtgcacaggcacaatcttggctcactgtaacctcaacctcccaggctcaggcaatcctcctacctcagcctccccaggagctgggatgacaggcacatgccaccatacctggctcatttttgtatttttagtagagatggggttccattatgatggccaggctggtctcaaactcctggactcaagccatttgcctggattggctcccaaagtgctgagattacaagtgtgagccactgcgcccagccgagaatggcatttttatgtgttttaagttcagtaatgtgtaaatgctcaataaatgcttgcaattatcacatgaagcaatttaaaataatcagaatttgtatgtatgagtcccaagttacttcgcaatgtttatggactattaaaaaatgaatttttaatggatccctaaaaatagacttgtcgtcctttcttttcttcccttataaatgaaaaccacagggaaataagactgagtttggagaagaataagagagcattacaaagtgataaaacttaaacatggttcattaggaaagaatgactgaaattctaatcctgtgcaggtccaggattatgagggaagcaaaaagaatgccactgacactagaatagaatatttcctgccgggcacggtggctcacgcctgtaatcccagcactttgggaggcggaggcagtggatcacttgagcccaggagtttgagatcagccgcggaaacatggtgaaaccccgtctctaccaaaacaaacaactacaaaaaaaaaaaaaacaaacaaacaacaacaacaaaaatagctgggcgtggtggtgtgtgcgtgtagtccccactactcaggaggctgaggcaggagaatcgcttgagcccgggaggcggaggttgtagtgagctgagactgcaccatggcactccagcctgggtgacggagagagactcgtctcagaaaaaaaattcccaaagccactttctagctaccttacaaagaaaggtgccatatataatatatttcatgtaaatcctgtggatatgactttaactggagggaaagaatctccgagttttacatgctaataagccagagactccagagtagccctacagcggaccacaggaacacaggggactcattggtgaaacttccagttggagaaatgctgagccaaagacagaggctttggaaaacactgtgggaaaaatatactccatggaaatgtgtgtcttaaaacttttccgtatgaaaaactaaaaatatttcttcctccacagcagcgttctaatatataagtagtttaagaactactaagaaggaaagaacaacagagatttttgtctttggttcaaacttaacattgataaacactttgacttgcaactcagtccttgggttgcaagaacgactgagaacaaaaaatgcatcggacatttctaatgaggcacatttcttttccttgagatggtacttcctatttccctgtagctttccatctgctgaggttgagccatccatacttcttgagaagggcagaactcgatggataacaaaaaaaccattgttccattttgacatcaaaatagattttgaaagttacaagaaaaacaataggcataagtgtctaggtttcaatttcaaggaccaggtacctgaaggagaaaacagaaaagtcttttcttggtttcccttagctggacattcaatatccagaatcaatctttggactttgaagccaaagaattttccagcatgctcttgggtgagacagatgttagacatggggtttctctccacagagggaagtagtaaaaatcctggattgagggaatattttttaggagaaatttggagggatgagactatggtgaaattgctacttgggttccttctgaggcacccggtacgcccctactcccttgtaactcacgagaaagagaagagatgaaagagatcatagaaacctcatagatttgagggggcaaatgaaaatcagaaaagtcccatgctgcaatttggtatttggaagtaggtcaccgagcccggagccaaaaggaggtagtcacagtagagtaaccaaggggctggctgtgttgaggcctccccgcacccactgccagagccgggaactagggaggatcacaagttcacaaacgctcctgtggctgtgagatgagaaggccaaagaacctgacaaccctgcagccaagatgaggagggcagagtctgtacagagactgaggctggaaggcagaggagatttgcaatgaggacagaggctgacacgtcaaacacaaggggaagtgccatgtggaaacgccagggagggagagaggcctcatgccttgcagttgtgacagcacataaattttttttttttttttgagacagtctctgtcgcccaggctggagtgcagtggtgccatctcagctcactgcaacctctgccccctgggttccagcaattctcatgcttcagcctccccagcagctgggattacaggcgtgagccaccacccctggctaatttttgtatttttagtaaagatggggtttcaccatgttggccaggctgatctcgaactcctgggttcaagcgatccactgcctccacctcccaaagtgctgggattacaggcattagccaccatgcccagcaggaaatactctattctagtgtcagtggcattctttttgcttccctcataatcctggacctgcacaggattagaatttcagtcactttttcctaatgaaccatgtttaggttttatcactttataatgctctcttattcttctccaaactcaaagtcttatttccctgtggttttcttcttctcacaggttcctctttccccaaaggaacaaagaaaggatggatgggtggggtcctttgaggctggatatggtaaatgctacagagattgagttaacctggaaaaactgtggtttgaaacaggaagtgactcagtttccttgaataggtgagtgaggtctaggtaccttcctgccaagtagagcaagttgaattcatattttataaataaaggtgcttttctgcacatgaatggtactgtgcattttaaaatcctactatacacgaatacttaggggatgattgaactggaaaagtggagaaagggtaagattggtggggtcagtataatggagcatatattgtttctataatatatatatatatatattttttttttttttttttttttttttttgagatggagtctcactcttgtcacccaggctggagtgcaatggcacgatctcggctcactgcaacctccgcctcccgggttcaagtgatcctcctgcctcagcctcctgagtagctgggattacaggtacctgctatcacgcctggctaatttttttttgtatttttagtagagacggggtttcaccatgttggccaggctggtcttgaactcctgacctcaggtgatccatccgccttggcctcccaaagtgctgggattacaggcatgagccaccatgcccagccttgtttttatacttttaatctaagaaatccatttgcacaggcccagcccatggatctgtgagtctagcatgtagtatttcttggtgagagaaactagggatttcaactatgcacaagtgggggatgtgggagggggaaaaagaaaaccattctaaaacatttaaaatttactgttcgtggttacaagtttccttaggagacataatatttttttttctctagtctaaaaaaataatttggactaacctcaaaaaagctgggtttaatgtttctcagactgtttccaagcagactaaaataccaacaaactcatatccacagggagaggtttatggttcaccaagtttgcatgattcatgctgaagaacctacacgcctgagatgcatggatgtgccttctgaatgcaacgtggggaacacacacacccaagcagtggattctttagaagggctgcctgacgtggagggccactgtggagaaagtggagtcactgaaaggaagacaggagaaagaggacaggcagcatttcacattcattttggatctgtatgggaaaagcattctggtagcagctttggaaatttgagttggatcaatgtctgagccaacagtttcagatgcttattcaaatcctcttcaaagcaacagctcttgagcttgaaaagatgagttttaaacattaaaaaaaaaatagcaggaaggagccatcaggatagctgggccaaccatgctcaaactgtcagagttggagaactaatttaatacaaatgaaagagcattttaaatggtccctatgattaaatatgttattattattttttgagatggagtctcgctctgtcgcccaggctggagtgtagttgcgtgatctcagcttgctgcaacctccagctcccaggttcaggcgactctcctgcctcagcctcccagatagctgggatcacaggcatgcgccaccacacccagctaatttttgtatttttagcagagacaggtttcgccatgttggtcaggctggtctcgaactcctgacctcgggtgatcctcccacctcggcctcccaaagtgctgggattataggcgtgagccaccccacccagcctaaatatgttaatttttatgaaaaggctttgtaaattctaaagtggtatagtgacacctgttactattgccgttgtcattttcacttagtcatcatgccgcccagctacagcagcccagaggtgatgtgtcacatacctcactgttgtggccctctggccatgaggtctaattacagatggacatggaactgtcctgagatttcgttctttctgtcagaaaataatcataatgctcatttgaatcacagaaatggctacaagtaaactaataaatgagagttgttctcataatagatttaaattatttcttaacgtttccattgtcatctcaaatcattacatgggcattggatacaaatgatgctagcaccctccctagtcagtaatgacaccatcatatttaggacatcaacaacccgagtaatgactctttttcacaatttagcctttcaggcactcaccctaggatgtttttttgacttggcaatgtaatacattgggatttagaagttatctaaaatttttcaccttgtagataagaaatctgaggaaatcaacatttccagctgggtactgtatcagttttctgtttgtcctcacagctaattccttgaaacatctgtttgtatttcatggtgtctactttcctacctttcattctttcaacacacttcactcaggctctgtctccgccccttcctggaatgtcaaccaggacctcgtcttgtccaattcaaaagattattctcggtcctcatttgttttggacactctgtagcatggataaaatggatcactcatttcttttcttcctgaaacatcgtcctcatctggaaactcttctgggctttccatcttactgggtaccccttttcaccttcggcctctaatgctagagtgcttcaaggccggttcttagaacttctctctatttacattcactgccttaagagacagcaaatagtctcatggccttaaacacaatttctcctgtggtgactctcaagtttatagcttgagtccaacatctttgcgatttgtatttcgagctgcctacttgacattcccatatggaaatgtataaacacacctcaaacttaacctggccacagatctctcggttctcttccacctcccaaattgctctcccttactcttcaccacgtccataaataccacctttc

SEQ ID NO: 272 - DNA, 10000 bp, Homo sapien
gtttcgcggaggggctcagtgaaaaaatgagcgagctagaggaagactttgccaagattctcatgctcaaggaggagaggatcaaagagctggagaagcggctgtcagagaaggaggaagaaattcaggagctgaagaggaaactccacaaatgccagtcggtgctcccagtgccctcgacccacatcggcccccggaccacccgggcgcagggcatctcggccgagccgcagacgtacaggtccttccacgacctccgacaggcattccggaagttcaccaagtccgaaaggtaggcgcggaggccgtgggcccgggcgctcgtcccggcccgcggcgcagaggctgggggctctggccgcggcggcgggggcgggtcggcccagggcgccccctgctcgctgcggcgcgcggagtgggggtggccccgcggcccgggaatgggaagtgtttatttttatttctgcccatcacgtgctgtgcttgtctccgccgggctgggaaaggcgagctgcacggggagacgcgcccctgtggcgtgggggtggggaggaggaccgcggaaagtttactcgcgcgggctaacttgtgccctccacacatggctgcagtcgcgcggctgtccttcgtgcgccccgctgggagcgtccacgcagggacccaaccctgcccatccaggggcctggagagcttcccagcggcgaccccccggactcaggccactggacatgctcagtggggctgtccgagcctcctagggaggggcgactggaggctggacagggttgggctcaacttagggactgaacttgcccagaacccgagctctgctggcggacgcggggacggggagaggcgggacaggggcttgtctctagggcagggatccagcctggagcgtgggggcgaggaggggagaggtttattcacagggtcactttcaaggcagctgtgatgtcagcaagacattgcaaagaaaccccaccttctggacgtttctttgctctgattgtgcctcttccagaagttcaacacctaaggctgctctaggcttggagtccgctcagtgaccttgcacctgaagcagatttgaggctgctcgtcagccctgtcccaaggtggatagtgcgccctccctttttgttttcccctgagtccctccctggaaaagttgggatgaagaaggcggaggggtgagggtaggctgtttctccggacgcctctgggctccttcctttcctcctctccggcactttaagacacaaatcctgccagttcaaagttgtatgtcactcctttggggtgtgcagaggaggctgggtggattttggccacaagtaggaagcttttgcactccattcgtcgccttcaccggagaaggctgatcgattggctgcagcattaaagcgcctctggacattagggagaggaagtgcagactccaaagcccattactggcttttagtccctggaagtgcagggccgaaaatgcatttctcaggatattgaatattccattaggcgtgccttcatgcccgcctacctctcttaatctttccctcttcttagatcatttgctgtctgagtttggggccctcaggggactcctaaactagtcctcctctctccgtttagctctctcacttttgaggcaagctcttctgaagagcatgtcctttccactgtccccatccaggtcagctccagggcgcttagtgtctgccactggcccactgcacctcctccgtgtctgcctctggagtccctcttgtgtattgattatatgggatggggagccagggaggctgagcagcggttcagagttattagaagaagaccaggagctgggagccagagtggggagaaaaacaggaatcaggcagaaaggactcctcttaaggaattgtgggaccttctgaacagccatctcagaagacagctttcagatttcctgagtgacatagtgacattccacttacgaattaacactgtgtacatggcacctttgggcccatcttgccttgaaagtccctgttggatggaacagtggcattttccttccttttctcaggactgcaaacagacctaatatttggccttgcccttgcctgggaagctgctgctgagtcttgtctcagccgggctgtgcattccgagcggctgccctgccctgcgctcagcagctggaatcaatctgcccacctccttaagaagccacttcatcagcggtcacccggcagctgctcgcctcccagggctgccgggctagggctttatcgcatttttgaaatttcagatttctgtgtctgggctatgcccctcgaacagtaacagcaccgctttgcagcagggaggagatttcaccaggatatggaggggacaggagaaaagccctccttcccagagtccactgtcattcaggatttgctctcaaagaggcaagaaatctctaagaatgaaaggaggtgttttgttgttgttgttgttttttgtatgtactgggaggaaatggctaatcttgggtatgcacacatcatccttcttctgtccttctctcttcccctccctttcccaacattttcatgttaggggtaggaacattcatcatgagtggatcatgcgcagtagccgtcagtgcatatttgtgtctacagcaaatagctggagtacttttctacttcctctctgtgctgatttacactgggagtgagggtaaactttttcccactcagcgtttagtttcatactttcaaatagaagtgtggagtttattttcagcaagctgactcattagagtttaaaaatttttgacaggtataatatatggggagagtaaacattagaattatgtactcttcttggcacttaaagagacagtactaaattgtccttggctagataccttattttggccaagaaaggaaataatttattaaaggatttctgggatacaatatttaatatgaaacaagatacttttaaaataaaaattgtttaaaaatgttcagataaggatttgacaagtagatattccatcacctcacctgtaatttttttttttttttttttttttgaggcggagtctcgctctgtcgcccaggctggagtggagtggtgcgatctccggctcactgcaagctccgcctcccgggttcacgccattctcctgcctcagcctcccgagtacacctcacctgttttttgtaaaaggctgtgccgttctgaagggcatgctggggctgaaacagaatgcgttattgcaaagcttgtgttcagttatgatttctgtagcatttgaatgataactattcatgctacagattcatttcaaactttatcaaaatacccagtttttataccaacaagaacagaaatgtagcctgaaagtgcagtcggccccttctatccatgggttccacatctatggattcaaccaactgaggatcaaaactattcaggaaaaaaaaaaaaaaagaatgattgtgcctggactaaacatgtatagccttttcttctaaacaatacagtataacaactatttacatataatttatattgcattaggtgttataagtaatctagagatgagttaaagtgtatgaaaggatgtgtgtaggttttatgcaaatactacaccattttatataaaggacttgagtatctgtggattttggtatcctcggaggtcctggaaccaatcgcccatggatactgaaggatgactctgtaggaattttatttattgaaaagagtgatgaaaaacttttgcctataaacactgcttcaatgaatgattacaatcttaaaaatttacgtaataggtgacaaaaatatcttaagcatgtatcgtagacgaaggaaatggaattcattaacgactgtaatctagtcagtccaattagccagatttctatgtgtccacagagggtataatgcacaatctccattaagaatgatctaagtatctaaggaatgcttagatgaaaattatactaggaaaggaagatctgagctctcagcataagtatcaagtgtacaatacgatgatcatgtttaaaaagaacatatccgacttattgcggtactcatttttagatcccttaagaaatggccagtagggatcaagtgattatctttgaaaactgcaagctgttttggatgatggtgatgatattttacatttatattttaaatactgtttttctgccaaagaactccaagtgttttacatagatctctgtgaactcttgattttcttaatgaatatactccacatcaagaattacctattatccttaatcctttcccttactctttttgcatacacccaaactccttattttggctgcctagttagccagtgtatgctcaggaaccgcacacaattttttaatgagtttaaggaaaggctagaatcaatattaatctgttacaggaataaaaatagacgtattccagacacatttgagttattcttgtcatgaatcgcttgattcttgataatgtaaattgatcatttggaactggaacttcctttcactggggcatggatgccttgggatggatgccccagaagactcattaccttttgtctctctgatccaattcacatttgatttgaccttaggacgaaatcaaggagtttggcctacttcttatataagcaaggtcaatgaagtgagtaggtcttagctgaattctgggtccagagtcaattatttattaactgatcatgtggaaaatacacaatgctataaaatagcaatgaaagcaataatagagatagctaatcttagcaatcttagagctgtgctgagctatttacctgcactagctcatcattttctcacagcagccctaaaagacgtccccacttttcaggcgaggaatctgaggcttgaagaaatttaagtcacctgtctaaggtgtcactactaggaaatgccataaagtttcaaacctaaatctcgaagagtttagagcccaagtactcaaccactatactatatgaacttggaataggactggttctagtttagtaagtggggaatccttctaaataggaagaaatgaaccttccctaaattagaatgggagttaaaagtcttagagccaatgataggctaacctcatgaaaaagtgaccagtgaatctttgtatctagcacatgtccattggatctgctgtgccaggctggaatttcctcagttagccctgctcttgggattgccatttaccagtccttcatcttcttccttcctcatccaacttctctagctcagtgctgtgttacaggcagggcatatgataatacagttatgaaggatgtgaaaatgaccttggttgcctcctttgaataccctttgctatttgtcacttgtgtcattcatgctaatcccttcatccctacctttcccaccatcaacatggattgattactggctgataatatgccaagatattaacctgttacctctttctgatgaacgtggtgatgtgctaacaggagcttttgggagaggatatttatttaatttactcagctgagtaatatttctgacaagattttaaggggaggaaggctgaggaagggaaaggaaaatttttaggcagcacggcttgtaaacatccttgtatcttgccagatgtgatttgaagaggacagggcttgagcataagcacttcatacatgctttcagtcaaggctgtacaggaggtggtagtgtcttgattttagtgatgagaaaactgagcaaatcctcgtggaagtgtcctttaaaggatctcagaaataagacctgaaagaaaatttgggttgtttgtttttttattttgcatcggtaccagagttggtgaattgaggtcttcaacttatctgtttaacttgttatttaagacacattgattttgctttggggttagttcaagttccagagtcttgtgcattttccaaatgtatttctaatacaccaggagttcttgttccatttgaattaccaatatatgcacaggttgaaagtttacatttaatcatgtattcactggaaatttgaccctcatgaaactatttctaacagacctgaaaaaacaaaagatgtcgtatctttttcctctttcctgactacgggcctgtttcctagtgccctctcaccatagcatgtaagagatgctgagagtgcgttaaaaccttttcttttgataagattttcaggtgatttcatagttgctcagggtatgaataattattttcatttgccattgagaatctgcttatcagagttcaggacccttgttatctaggtttcttgtagctcttggaagttactgtgagctctgagataaaccagggatagcatatcctgtttcacaaaaatgaaagctcagaagtttgggaattgtcagaaaggaatactgaccttgagtctagagtcattggtgtgctgtgcttttgggtccctgaagagaaaagaggaagtaaaaaataataatttaagggaaaagaaaaatatgtgtatacatatgtgtgtatatatgaacacatacacacgtgtcaaactgtcaccactttattaaatttacaaatgtgcatttcttataataattattactgtgaaaaccctctaggttgatccaaatcagtttcctatggaaaggagggtttacttcttaggtctgttattataagtagatcacagcatcttatagtttgtaaaatgcttgtgcttcatattagtcacatagcccagtgcttagcccggaaaaaggtactggattcagtgtttgccactccttgttgaagtatttcatccttcttttacccagtgatgatttttcttctccttttccatgctcctggatctgcctgtgttgtgtgtccctctttcgggtccttgtgtttcttctggcttaacatctgtaactcctgttagatctgttttatttgcacaagtcatatgacagcaaatatggagcagatttcttactcaaactattactctaatctcttaaaatctttcatgttctcagatgtctcagatattatataatttaaattttctaaggtttcagaaataattatttattaatcgttcatgttgaaaatacatgctttaggctgggcacagtggctcatgcctgtaatcccagcactttgggaggccaaggtgggcagatcactttaggtcaggagtttgaggccagcctggccaaaatggtgaaacaccgtctctactaaaaatacaaaaattagccaggcgtggtggcacatgcctgtagtcccagctgcttgggagactgaggcaggagaatcgcttgaacctgggaggcagaggttgcagtgagccaagatcgtgcccctgcactccagcctaggcgacaaaatgacagagactccatctcaaaaaacaaaataacaacaacaacaaaacaaagctttaaaatatttgcaccctgcaaaatggatatatccagaaaatgtatgtcttttaaatagatttgttttattatataatgactggtagtaggaagagctaatgctgccctgtttgtcagcttatgtgcctgttgcttaagatgaagcagaagttcgtgtgttagaagaagtgacttaagctttgctactgcagcgtgctgcacgtaaagcatgtagttgatggagtcaggccaagctgttgggcgtatagcgtagtgttgagttgttagttgttagaacagttttaagaattgtgttgcttagcagtatgaactatgatacgagaagcccagtactagccttagaagaagttagtgtagttttaaatgtcagatgcaatagttaagtgttatattgactcaaaagttttaaaacagctgtaatttttcctgtgccagtgtgctagccgcatcttcaacctttttctagtacatattgattttatatattcttggaaattagtcctaagcagttaatttgttattcaaggatttgatttggattgattttgttatgtatttgaacccactgatagcactttcatgtgcaagatgataacatgactgtgctgatttcatctgagtgtttatttattaaggcaaatccaggaagatgactactgtaatcagcttgttaggatttagtttgactgttttatttgtaataggtgtattgcaactacacttcttcaattatcctctcggacttattcctaattcagactctccttcctttttagtccaatttagagagtactttaaaatgtgttttaaattctcagatgtgtctttatttgagtactctggcctcaaatgctggaaaagtactggcaaaaaccttatagggttctaaaaataattgtatgtttgcctcttgcaaatatttgtgggtctatttattcaactatatggtactgttattgtctaataagcaaatctataagcctttgggtaaatgttaatatttttcttgatgcttctcattgcccccatagtgcagataatactaatttcatgtatcacatggtcaccaagggacttggctacatatgctaaaaattttccaaatagaaaattattttgtatctcaggttgtaaacccttgggtagaaaccaggtctgtttacagtaaaaattccagccaagtaaaaacctcagcttaccatacatttctcttcccacatgctacttttcagagaagaggtaggaggagcactatctagaacgtattaaaaaacaaattttaaaaatcctgaagccttcccaagaataaaaccagttcacactccatttggtctcctctcagagaaaaatatcactccaaaatactcaatccaatatcctgtgctttactctggcaggtttaactgtggtgccatgacaatggtgtgtatttgattagttgtaaggtagaaatgagtaaataatggcttaaaaatcaaaattcatgaataatttgtttcttaaaaaataagattgcgtgcactcacaggcacctcccgagggatagccattttcttgcattccagttggctttcttgactgggaagattacaaatacatggcaggaaattgcacataatccacagacagtcttgtcttttcacaagagtatgttgcacatgggaatgtcatctatcttgtgaatcactgcagaaaaaaatgtttgagagcctctgatctgagctatggttctgaaaatcagaatcttgactctgtgtcacttaacgctaattatttataagtaaatgtaagattcactagattctacttagccagcacctgaatttcataacaatggttcccaaagtgtgatgtttatataattggtggcaccagggatgcttctatgtggtagagaagtgaatttattttatagttatagatattttaataagtgttgggagaaaacatacaacaatcacatcaaatccatgctgtgtagctatgttgctgagggtaaggctaagtattaagagttcatagatttttttttttaagaatgaggtgtaaaaatacagattgtgcgtaatgtcaataagggtacacaagaaagttttgggaaagattgttttaaagtcattttcaacaaggaatgaaatggattgttctcctgtttgtgtttttgctccccactgccctgtttgaagaattctggccgagttctctctgtatctgtgtttgaatgactccttgcatgctgtttgtcaacttcttcataggaattgctgtggggacatagagttagatggagatggtggttttcatgaaatatattcttgctttgaggataagtcattctggttaaaaattgctcacattaatacatcatcagaaaaacatttgactctcatcctccttcagatttataaactctcttgccttgagacagtgaggtccatggctgaagaggccagcctagaaataataaaggatgctggggcacccacttccatccagtctgggttccctggggagctctcacttcccgtactgtctccacagcgaggcctctcatttcctcctccag

SEQ ID NO: 273 - DNA, 10000 bp, Homo sapien
tttaattcaagataaggatgataagtgtacatgaagtattacagataaacaggactctctggcctctcctgtgtttatttggtaacgaatagtagataatctctatgatgggaaacgctgaatgacacgtgataatttcattcattcaacaagcaaatattccttaactattaggtgctgaccatacagaaatgacagtgatatgatcccaaatatatattgcttttgttgatttagcgcccaatattttatgttatttgtgagttaaacaccaaaacttagtgaaattacagaacttcttaagtgtaaaataaagcagtgtggttaggcaggattttgtcatataggcactatatgtagaatagtggtttcagtagatttgtcttcctctaaattcactcatgacttgcaatggatggatttttttctttgctgagcctcgtctgacagctgcacacgtttcctctggcttctctcttttaatcaagggtttttttgcaggagccttcattctccacatcacaactgggtgccggggcccagcaggactctggattcggatgatcttggttgaggcaatgtaagacattttcactgtttgcactacagcattcattaaatttttggctgcttggatcagggatgtgacactgtccaactgtagggaaaaaagagaaaaaagagctattattccaggaggttttgttaattattgccaagcgtgggcatggtggcatgtgcccgttgccccagctactcaggaggctgaggagggaggatcacttgagcccaggaggcaaaggttgcagtgagccaagatggcgtcactgcaccgcagcctgggtgacagtgaaaccccatataaaaaaataaataaataataaaaataaaaataactgagcctgatagtctattaatgtcacaataagctgctcaatattgtctatgcccaaacataaatcaataagttctgcctcatttttttgtatctagatggataagtgattatgttcaattaactcttatgctaattatgtaatgtgttttgcaaataaccctaatacgccaatttaaatagaatcctgttaaatattatcctgtataaatcttacttttattatagtgtctcttctgtgctttgtggtattatatggtttcagtttaacaacggtacaaattggaccaattctacaaatgtttacggataaaggacttgctcttaaaaacatatcaatagccatttactacaaaaaggtggagtttagcaacaataaaatacattttctgtttcctcataaaatgttaacatttcgtccatgtaagtagtttgtatagaatacctggatcttttctcaaaaacactaaatacctataaatccttgacaactatgtcaatttggaatgtctgctagcaaacccttgccaaaaccctattgtaattagtgatagctaagaggaatattcaaaaagacatggtacatattccttctcttgcttttggaagtttctcacagagattgtgtcaaaacactagaatgctttctactcgtaggacactagtctaactccctatagtttggattcaagactgttaccagacatacgccttacatgaggattctaagcctacgtgaacctcacttccactggtgtggatctcactttcttgcacctggtctgtcacctgggaaagcagcttcccaatcacagggcagtgtgaactgccatgccaactgcttcttctgagactcctgctgagagaaaaacctgatgctgcttggaaagatatatggtctgtccagtaacctttttggtaaattggtaccaaatgtagcctatgatcttgagtctcaaggtgtacctgaattcaaagacccctgttggatgttggtcctgcacaaaagcaatttttgaaagacaaatgtcaagagtttggttccaagtgtcagaagagcttaaaataattgctaatatctattatatgctgtagtatgcagttgacataaagtaactcatagcaaccctatgaggtaagtactcttattatcttcattttatggatgaagaaacaaaggaactggaaggtctggtgacttgctcaaagtaacacagatattagatagtagggctggaactggaaccaagtaagtctggttctaccttgcgttttttctcattacataaacctgcctccaagaatatcctacttccaatatgtgattatttttcgatatcaaatagttaaataaattatactaaccttaacagagtgtctaaaattttaaagttgactagccagcaactctgcttttaagaagcttgctcttatttttgtaatgcatgttgctaccaggagcaatagagtatcttatttgccaatgcattttgttaggattgtggtttgaaaatttatatactaatttccaagttgtgtttctttggaagagcaaatagaagtactcagtcacccttataggccccaaaccatttaaagacatttagattaagactatttcataacaaaacatttttaaattttaaaacctgggtctcaatacacatatcaataaggcaaagaagaaccataaacaaatcacattataggttctaggacatggaagtacataacatttatctttaaatcttttaaatgtgtcagtataaatacaatcctgattaaccaaacttttttttcttattctccaataaaattaagtcaatttgtttgcttggttttgcaaaaataacaggatttgatcctaggactccagagtttcttctcaatgtagttatttttaaagttgtattcgttcatttacacactactacaaagatactacccgagactgggttatttataaaggaaagaggtttaattgactcacagttctgcatgtctggcagggaggcctcaggaaacttacaatcatggcagaaggggaagcagacacatcttacatggcaacaggagagagacagcaaacaaaagcagggaaaactgccttataaaaccatcgatctcatgagaactcactatcacgagaacagcatgggggaaactgcctccatgatccagtcacctccctccctcaatatgtggggaattacaggtcgctccctcacacttggggattacaattgaagatgagatttgggtggggacacaaagcctaaccatatcaaaagtaatcagttaaactatttggaaatgaagttagcataggcaatgtcaaagggcatatgtatatgtaatggcagattacaactgacagcataaactatttctaaaaagacttaaggatatttgtagtctttttaacttataggtgccatttgcacctcaagattgacctaatggtagtagttttatgccacagtaaatgcttaaatatattttctgtaaccaaaatgcattaacttattcaatgtttttatgatctactctgaatgtctcttttaagagctaattttatcccaatactggcttaatacattcttttgtttctgaacagatttttaaaagaacggttggcattgagagcattctcccttttcagatgcattcaaaaatgctaaacagccagggtggcttcacaggcaaatcagataaggagctttgttaaatccaggcaaagtggtgttgcatctccaaattgaaattgtcaagcttctaattaaattgagaaggtagttcattctttggatatgaagaatcattccaatgggccactgatataattggcacagtagatttgtcctttgtcaatgttccgttagaatgtgacaacaaaagacaacaacttaagttgaaaggggagaaatcaatgcatgaaataactaaaagaaaagtaaatgtaacactacagaaagggccatacataaaaggaaatatgacatttattcagttataatcttgtcctgtcaaaaagcatctataagatgctttttttcctaaagctaatttttttctgaaggagatactctaggccagaaacattttatatcccgtaaaaagaaataatcacaaacaatgccaattcaggtggctactcagaattccttttacttttatttaaaatgacctattataaaaatatacatattggtaataatcctaatatttagctatccttcaaccatgttgacttaaggcaaatgcttagctgaagaaccaattttccaaaatattacagccctaattaaacagattcagaaaaattagtatattctttcccatgtagagccagcaagagtgggttaggtatggcatggttctctcaacaccagtgtttcaaccttagcttcctcttctcagcaccatcaatcaggacactgagatctgccctctccatagcgggctgtataataatattaaaccctgcatcttgattatgcttcaggatctatgagctaagagtaacaaagcaccagcctccatccttgatcctacacttatgtctttcttgaccataagcaaggaacaactaggctgcgtgaaactaaaagaccaaatgacattagttttacaacccatgcagagcttccagaccacagatattttcacgtacctataattttcaactctttcaatctcgatcattctaccattttgataatatttggcaatatttaatatttcttagctcacttctctctctactacagatgtcttgcagaacaaaattatccatttccctaacactgagccaacaggtgactgtctaccatttttagagaatccccttgtattagtttgttctcacgctgctaataaagacatacctgagactgggtaatttataaaggaaagaggtttaattgactcacagtttcacagggctagggaggcctcacaatcatgtcttacatggcaatcaaggcaagaaggaacaaagtcatgtcttacatggtggcaggcaagagagtgtgtgcagaggaactgccctgttataaaaccatcagatcctgtgagacttattcaccatcatgagaacatcatgggaaaaacctgccccatgattcaattacctcccactgggtccctcccatgacacatggggattactacaattcaagatgagttttgggtagggacacaaagccaaaccacaacaccctcactgaacaaattagtttctagataaattaatggtccccaacctgaaactaacagaaaatgcatctgtgtgtttttagctaattcttgtatccattctacccaaacactagtctaaacttccactttcatcaaacctctagcccctcatattcccacttgttctgcagattacttcacttacaacaaatatgaaataagcaaacagacaacaacaataaaatcgaaacagtaaaaatgaaactgtccccaacttctatctttcattcttatccatttctattaaaatgaaaattatctggttctcttcctctctaccttcttgcagactttgcacatttaataacttctttcttctaatatatcttttcttttttttgagaaggggtctcgctctgttgtccagactggagtgcattggtgtgatctcagcttactgcaacttccacctcctgagttcaagcaattctcatgcctcagctccccaagtagctggcattacaggtgcatgccaccatgcctggctaatttttctgtttttagtagagacgggttttcaccatattggctaggtcagtccccaactcctgacctcaggtcatccgccttccttggcctcccaaagtgctgggattacaggcataagtcactgcacttggctcttcttgtaatatatctttattctattcctttctactgactttttcactgtagtatataagtgtttataaaaccatatcttaaaacatagccagacttattaaaaggttatctattatccctaaaactattttcctcacttatcacttcttaagccatctgattcctttcatataaatgcttcccctttatatatatgtatgtatacacataatatataaaatgacacatatatatcaaatatgtgataggatatataatcagacatcttatatattaatatgtaatgtatgctagatgtattatataatatataatagatactaaatatataatagattacatacatgttaaatatataacatatatgtgaaatttttcaattggtaacctgcataactgttttctttcaatcaaatcacatttataagatcaattatttctcattcttgaatgcttaattacatataaatatcacagtttatccattctactattaataggcttttaggtagtttggagctacttaaaatatataaatataaaataaataggaacttatgaatattctagtatgtgtcttttggtgaacaaatgtatacaattttatcaagtatgtacctgagagtgccactgtggaattatgaaaatgcatatattcagttttattggataattccagggatttccaaagtgcttctgcaaatttatatttctagcaacaatatatgagtgttccaatttttttttttttttttgagatggagtttcactcttgttgcccaggctggagtgcaatggttcaattttggctcactgcaacctctgcctcccgggttcaagcgattctcctgcctcagcctaccaagtagctgggattacaggcatgtgccaccacacctggctaattttgtatttttagtagagacagggtttctccatgttggtcaggctcgtcttgaactcccaaccttaggtgatccgcctgccttggcctcccaaagtgctgggattacaggcttgagtcttccaattgtcacacatcttcatctacattttttttcccatatttttcacattaggcatttttgcaagtatgtagagatattatattgaggtttaattggcatctcattaattactaatgaagctcagcatattctcctatggttacagctttgacttgcacatacagacattgttcaattcaatttttaataatccttatatatttttctatagtcttttagattttctatgtatgaaagcatatcatctatgaataaagacagttgtatctttactttttcattttttttaatttttgttctgtattattccactagacagaaatgccagtatacaagtgagcatacaaggtatttttgaatcatactctaactcagggagaatgatttcaatatgttttcactgattttttagttaactcacgtattaaacgagtctttaaaaatttttctagtaaatgaggacttactagtcttccttttactattgatttctaacctaaaatactattgtgattaaagaataagctctgaatgatttaaaacattttatatttgtggatgctttgtttatgacgtataatcaaatatcatatgctttaggtacactagaaaggaatgtgaattctagtattgttacatcagtgttctatttatgtcaactggtttccttaagcctattatcagtcaagatccttcccaccccaggtatcaggcatccacagatctgctatagagcaccacagattagatgtatattttctatagttgtatataaatggaattctatggtatgtaattttttgtgtgatgtttcacatggcattacatgtgtaagcttcacgtatgttgctgcatgtaccagtagtttattttatttattgctgagaagtattacattttatacatatactgcaatttgttaattcattatctttgtgactggcatttggtttgtttatttcatttgctataataaataaagttgttatggcattattgtacaactattttgtattgtatgtttttatttctcttgggtaaataactagaagaaaaactatgttctgttgttaagtatgtttctaacttcataagaaattaacaaactgttgaccaaagttattttaccattttgaattccaccagcaatgtatgagcattatagttattctgcatcctcagtcacacttggtattttgatattttgattctttttacattttaggaattttgatgagcataaagagaaatgtcactgttttgttttattcatcttctatggttaataatttttgtcctagcaaaaaatggctactacaatgttaaacagattttcctttatgctttcttccagatatttgaagttagagatttatgtttatgattatgcttactttgtattaatttttgtatatggagtaatgtgcagtacatttttttcatatacagatattgttcaagcatcatttagtcaaaatgattttcttttctttttaaataatcttggaattgctgtcaaaaataaattgatcatatatgtttggctctatttctgcttcatttctatgtctatctttataccagcatcatactatgacgctaacatcactttctcagggaagagttccacaatactaagactagattggatcctcttttttatgttcttatagaaatctatacttcatttaacattagattcatcagaaggcaatatgatccatgtaggtggagacaatgttcttttttacccttttattacttgacacagtctacaggagatatctggcatatgaataagttactggaaatatttcttatataaattgtagaattattaagtgcagaaaccacatgcaaaatactgtcaaaggcagacatgaattcaattattctcttgtattctgcacaaactgttaatattttccagacatttcataccctcactccatctaccaggaggtttctggcctctaaacatggcacaaaaacccttgatcaaataatgtttctcattatttatgtttaaaactcagaatgcaaatctgttggaagtcatgcttgtcagaaagttccaaagtcccaaattcccacttttagattattatttctcttttttttattatactttaaagttttagggtacatgtgcacaacgtgcaggttagttacatatgtatacatgtgctatgttggtgtgctgaacccagcaactcgtcatttaacattaggtatatctctaaatgctatccctcccccctcccctcacccacaacaggccccagtgtgtgatgttccccttcctgtgtccatgtgttctcattgttcaattctctcctatgagtgagaacatgtggtgtttggttttttgtccttgcgatagtttactgagaatgatggtttctagcttcatccatgtccctgcaaaggacatgaactcatcattttttgtgtctgcatagttttccatggtgtatatgtgccacattttcttaatccagtctatcattgttggacatttattaaaaactaacttcttgagaaatatgtcttattggcccaagaacaaaacatcagttttatagtcgacaacctgtgtttgagtcccaactctgccacattctaaatacaaagcctggggagaaatcaattagcatatcttggactcagtttcctttcagcataattacaatacaaatacatttcagtattgtttattaagatttaatgtgataacagctaatcttagatttgtgtatacacatacccatgcacataaatgaagctatagcttttctttctttcttttttttttttttggagacagagtctccctctgtcacctaggctggagtacagtggcgcaatctcggctcactgcaacctccaccttccgggttcacgccattctcctgtctcagcctccctagtagctgggactacaggcacccgccaccacgccctgctaatttttgtatttttagtacagacagggtttcaccatattggtcaggctggtctcaaattcctgaccttgtgatctgcctgccttggcctcccaaagtgttaggatacaggtgtgagccaccgtgcctggccaaagctatagcttttataagtttataaggtgaactggaaaataatattacaccaaatttgaggattttggtggaataaagcttaggacaaattc

SEQ ID NO: 274 - DNA, 10000 bp, Homo sapien
taaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaaggtaaggcaggggtttcgatggatcatttaaaattttttagtaacaccccctcaagcccttcctatcccccattccaaaggggaaagaagaaaataagccaagcagatctctcaaagagaagaaaagaggttttccttctcctggattgtgtgctgtgaggctgtaactagtgattgagaaaagcaatgttttctattaagatgcacatgtttgcaatgcagaaggcatttcagaaacttatcagttatgactgaaaaaatgttgtgcttacatatatccacaattagccttcccgtctacttctgaaaaagaaacaagaggttcagagcagttacaaaagcgaagaaaaggtctcaaacaacaaagagctgaaaggaatgggtatgtgtgtgtgtgtgtgtgtgtgtgtgtgtatgtgagacaggagagtgtgtgtgtgtctgtgagtgttcaagcgggattgcacgaaagtggaattttccacggaaagatcgtttcgtcagttctctcccactctcagaaaacgaatttaagcagaggcttgagtggtgggcaagttggatcggagttaaaattttttattttatatcctccgctgtcatttccagacttcaggactttgtaaggcgctttttatagacggaatgcccccctccccccgccagttcctcctccttaaatctcctgcggtaactgcacagtttagcttttctttaaaggaaaaaaaaaatcctcgctggggtcacagcgttataagggaagcggtaagagtcctagaaatactccagggaggcttcggagatctgaactccgcaccagcagattagcaaacccggaggtttgtgatcccctttgctctagggcttgtaatctaattgggctcacactcttcccgggttgttgcagtttggcagttaggcaactgcgatcccttcccatcagggacagagttgcagtgtaaaataagaaataaatcctctgcaatgtcgaatccaagtgttgagtttttaaaaattccctacaagttggagcctcagctgtgggttcccctcgaagagccctcagcgctctcagtcccactttgccccgaggccaggtccgttgtgcgtccttcgtatttttcactccttgcgaaattcgagttttgcttcttgaggtgcgcccgcctctcagctcttggggttgtccccctggcccgggtcgggtctgcggacgcggcaggtagcgggaggcgccacgtggagcgctccttccacgtggaggaaaggtagccggaggactgagaggctgtagctgcccttgccgaggccgtttcggttcctgttggtgcggttgccgcgagggcggaacagccagctccgcgcggcccagcttcctcttcgaaagctctttcgtgcagcagagcgcgtctatgagctcgtccgaatgtagggtgcaacggagttttccgcaacgcttgtcccactttcattgaactccttcagctgcgcagaccccctttcccccaccagctttctttctttttttaaaaaatctgcctgttcgcctaatgctttcctgcctcagaaaagagtctggaaggcagattttcggggaagaagtcctggcggggcgcattcgcattggctgtgcaggcttctggatgaaaggttgttggaactgccctttccccaggaccggattcgcgcggacgtctcctttgccacagtaggcccacgcgacgccctgactgtgcctgtcctggagtgcggtcccggagacttctgccaaacgaccattctggttacaagaccctggggtagccacgtctcttctcaaaaaactctccaaaagcagagtctgttttttctttctcgtatccacctcctttatgatgctctttaacgtcaccatgtggatttgggttttcagaatctgaaacagtaaagcgttaaaaaataatttacagacccggaactcaacagctgatcccctctgcattatcagtatctgcattgctccttttctactccttcccaaagcagcagcctttggcttttaaaaaacctattgatggaaatcctgaccttaaatagatgcaaatgctattgttttgtgctcatttagtatcccataacgcgcaggttccacatttcggcaagcttcattttccctagcggttccaaacggccccaagtgggaaagaagaaagatggagcctaactcgggggtggggtggggaggaggatgttacctttcctgagatcaggcggaattatttcaggggccaaagagactttgcctttactgtgtgtgtgtgtgtggtggtggtggtggtgcgggagtggagaagtgttcttggaaaggcgagggtttaccctggggatctctccgtccggggatttgggaaacaatgcagtttttacaatatagtgaaaaaggaaaatcaactcggacattaaaagaaagaaagtaggaatccacttaagctcaggcgccgggcctggtctgagagaaacaaggcaggtttcacctcctgcacggaggtttgtggggcccctggggctgcggaggcaatgccggctttcagcatacaagtttttggcaacggtcggaagccagaggtaggcgcgcctagcgcgtctccgcccggagcgctttcctggcagtggcagaagccgggcaactgcgctttagcgccgtgctcgtagcacgtacacccaccccatacaaacactctatgaacaaacactatctgtagcctttaggagatcaggatctgggtgtctgcgggagggggccgctgcgggcgtctggaagcgggaggcacagcccccagagccgggcggtgagggcgggctggggcgcagggcagcggccaagggccagcgtggactgccggctggggcaggcacagagcctctagccccggccaggtcgccctcagggagtaggaagagggcccttctccgtgccccacgcgctctcgtcctgtcctgggaacctttcctctcttattctcttcctctgcagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatggtgagaaacttgattaccattctttatttggggagcggaagcaagcacccgctgtgtttgtgtatctgtgtgttcgtgtgtctgtgtgttcgtgtgtgtgtgtgtgtgtgtgtgtgtgtgtgtgtgtgtgtgtatgcgcgcgcgcgcgttggggcagatttggagagcctggttgcacctcgcctgaaaatgaaaagttggaagcttcagatgaggagacactgcagtgtggaactcctgacctcattgcgcaaagggggttctccaggttgttctcacccagctgccggccttttgctgggcggctgtcttggaggctgagagctggtagcccaaactgcttaacaggctgttcctgcggggtgtagatgcagcaggttttttgagaaaattcagccaggttcatagattattaaaggtcagagtcatatttcattgctaaaattctaggcaaagtgcctttctgtttttcttatttcttgccttcctgtgattagggtacagaaggaattcagccgtttttgaaacccactctaaagttttctggaataatcccttttaaattggtcccttgttgaggaaggtttggaaatctccacagttagttcttcttcagattgcctaatctcagagttgcatttttttttttctgttttaaaatgggattacaaatgccagctttctttcctgacgggattagataagtgttggaagggctttgaaaacttgaaatcttatttcaatctgagaggccaatcttttttggtttgaacggtctcatttttactagggataaaaaatgaaaatgctattgaaaattttttgtttagaaggttaggtgttaacatctatgaacttcctgtttaagtggagggatgtactttcaaagaggcacgatggagggtattggcgtttcttgagctattgacactgttaagattggatagaagaggcattagtgtccattcttggagggctatcatccccgttgctgttccttcttataagtaaactagttttatatgtaaagggctcagggacagattttcagagccttctgaattttgttatatcttgtccttacaaatcagctaaaggagcaaatgcccttgtattttcttgggccttcattgaaaagtacttctggagaggtattggaatgtatttcaagggtggcagaggaacatttttttttaagtgccagaatagagaaagagggcaaggctaaggcttcttgagtttggagcatgactaggacttactcttttataacatttgccaaagcatgtaggtgtttaaggctatatcttttcaaagataaaagtcattgctatgaaagtatggattgcaagtagacttttgctgtcactcagcataaatgctgaaaggtaaaagatagtctttaacagcacctcctatggtaatttgacccagaaccttatagctcccagggtcactgtcagctctgtgatcagacataagaagggagaatattaatggtttttctgatattaatggtttttcttcttccaatccatttgaactacttcctctttagtttgtgggaaaacttgtaagagccccaggaattgctgggggtgagggagggaggaaaggaccattataagtttagaaattggtctgtttctcccaactttgtacctaggattatgttacactgagaacaatgagatctgtttaaaatgaaggctacaatttgtttccctttgtgaaaggagaaagtgggcatcatggggagaaaagaaattggcagaaggcagtgccctgtaaaactatataaaattaaaaaaaaaacataaacggaaaagatctaagaggttaccttcagtcctctatcacgttaggggccagtataggatcattccatatggaatccttttcttgttttgtccaacctggcattaaatatctctaggaatgtagtttttcaccactcataggggagagagttcttctgtcccataagcttttgctgggaaatttctcctgaattttccctttataaggatttacaattattcctgtttgcattttttagacatctatcttcaaaataatttctgcctttggtgtgagtgttagcttaaaaaaaaatgtttcctcatagctgttttttatctagactacctggatctaattcttttaaaactttctttaaagtcagtccttccagacactaatctgttttattgctcctagccgaactccttttgatttatgttttcctagtaataagatgctctgaactatatcagtatttgaggctttagcagagttaaagagaatgagaatgtcctatttctgccctttgaagctcacatatccttaaattacccatactgtctttgttgttgcatgttgcattgcagaattcaaggcaaaatgttcttggtatagtctcagcaattttgaaaacattatgcttctgttgtcccttttcatctagtgataactgttatcatcatgagcatcttaaagtaattaagccttcttaggaaatggtcctgtagtaagcacttgggcataaaggcatcttattaaaaaatgtatttacttagacgtagtacagaataacaacatacattttgagtaataagatatacctactggcacattatgaaactgaatgatacagtgaagagaaaatggaatttggacttaggaaggttgcactgcatgcctggccctatgacttatgaatgtgtggcccagggcttactgtttatagcatgtggatgatgatgattacctgctgtaccttgcttctctgaaggttctaagaggtaatgtttgtaagttatttttttgactgcacaacactataagaaaggtaaggattcttacattcattaaaggcaacttcagcaaatttctaatatatatttaatgttttaaagtgggattaaggagtgagtaagatttaatgagactgaagcttttacagaaggcagaaggtagatttatggaattacctgagaggattgagagaatgtaaggagaattatctttaaggaacagagttgagaaccaaaggtggcttttgttatgtactaatgttaaaatgaatggatagttgtagcattgagcaaaaagcttccacttttctggttaatccgtttatattgctaccctgataagtttttttttttttttcgatatggagtctcctcttttgcccaggctagagggcagtggcattatcttgatttactgcaatctctacctcccaggtagagtgattttcgtgcctcagcctcttcagtagctgggattacaggtgtgcgtcaccatgcctcgctaatttttgtatttttagtagagatgggatttcaccatgttggccaggctggtcttgaactcctgacctcaactgatctgcccagttcagcctccccaaagtgctgggattacagacatgagccactgtgcctggccccgatgtgattttgttgttccccttgttttcccatgaattaataatgcaattaacaactcatgtgtcttctgttttccagatactttctgagcacattaatgcaactgtattttctctaactttgtaaaaccactgtttatgtatcactttgggagcttcactggttactcctttaatgcagttaactattctactctatgcttaggcaccttgaattatatacacaaatagtgatgatggaagaagtaaaaatagagttgttctttatacccaaggaatcttactgttgcctaacttcctttttgttctatgtaatgttatgctttacctgctctcaacaaggaaatcttgggttattcttctgttcttaagtttatttttttccagtcttcccctctttgtattgtattcaatgtgatttatttgtatgcatgtttttttaagaccataactgcatctttaatgaagatgtacaccattttttaaatgtacatcaaaagccagcttaatatttctaaaatgtcatattcatcatgttgctcttttgctaaaaaactatggttatttttggattgcttacataatatgttcaaactcctcaacctgacattcaaaacctttcacatttcagtctcagcttacttttactaccctgtgtttccatataccttttattacagcccaacttacttgattgttcactgtcttcttaaagcacctttattatctcaaccccgtacctttgttcagttactatatgaatatgcattgaatgtatttctcttggcttaagtcagagcttattccatctcacctagtttttgaaggcccattgcaaatgttccttatttgcacaaaactgttcttgaacaggtcattccacagtgatctcttctttctttagactgctgtagcttttactctttatgcttttcttttggctccttctgccttgttttgccatttaattttatgtatatatatatatatgtatatacacacacacacacacacacacacatatatacacattcaactttatatatatatatagacattcaactttatatatatacatatatatatatattttacctttccatctagaatgcaaattctttataggaagacaccgtatctaattattgtatatccacaatgtctagcctttatgacacatggtagatcttcagcaaattttcttgggtgtatgctaggttaaaagcactgtgaaaggccctgggaaaatggaggtgaccagtggagaaatgactgaaggtatacatgaagattccattcattttacactttcaacacatattcccatgcagtccattcttgatgcttattttttaatggcattcttcatgattttaaccatgtgctctttatctgtggttgtctaagttgtctttattttatgctatgtgttaaattaactttattacccagtttaaagccttgcactagaactacattttaaaaaattgtatctgtttctaccttgcctttacttttgcttttctttgttagtctaatgtaatttctattcctgatttttcaattcctggtgtaacagtgccttttcacaactttcaaatatcttttatctttatctcctgaagatttttctcttcagagagcttctgaattctaaatgatgaatgtgtgtatactttgtaaactctaagacactgtataactattattattctcttttctctaggaagcttttccacagatgaagtaattaattctttttctttttaatcccattctatcaatcaagacttatggtgtaagaacagcacaactgccaaaatacatatttgccttgaacttatccactttctattatctcattttatttcacataatggttttgaaattctgttacatttaataagtatgtactgattatctactctctgtttagtttcatgctagacaaagaatggcagaatataaaataaataaaagatgctatcccaaatcaccattagaacacaacagtaataattgctttaggcgagataccttaatcaagtgttggacttagcgggtggaactttaaaagaggatatttgcatagccttaaagcatctccctcataatatttattaactaattattgtggtggttttaatatatgtccacaaattctccacctctgggaggtggagcttaattcttcttcccttgagtgtgacttggatttaaagaagagagtctccaaaggggaaaatagtaacttttcactgaagaaattgacagatatcattttatcaatgactaaggttaacatcagcagataagtcatattgatatcatgtattattctctgatatgatataatgagaagggcacttcaccatgtaatattctttccccaaatctgtaactctcagtaaacatgagaaaacattagtcaaacccaaactgaaggatactctacaagatacctgacttgtattcttcaaaagatactgcatctgctgtcaatgaaccaatagtgtagttggtgagacaacattaacactgacaaaactgaagaataacagaaagacaatttagaatgaagtgctaagtggaatataatagtttgccagggtataacaagaaaagtagagttgaatgctggtgagacttaggtgggagttagataggtaggtagaccttagagagagagagacaagaagagaggatatgcaactcaagagagagagcatgaggcaaatcctcgtatatatttgggcaggaaggagaccaccctggctacatagaaagtatgttagaattatcttcatgtggtaaaaccatgtcaaaatctcttttatagaagcctatttacacatttttgttaaatagaaatgtttataattaaagaaaaatgtataaaataaagtacattagaaattatcccaagcaaagttcatattgctagaattatgtttaaattgagttttaatacattctaatctatttttcttaacttcaaaatatgtaattgaagaagaagaag

SEQ ID NO: 275 - DNA, 10000 bp, Homo sapien
agcccagacacctgctcactcaccaccagctgggctccgcctgggcctgcccggcacccaccccggccaccaagggcagcagcttttccagaatttggctggcaggcctagtcaccccacctcgccacctcaccactgcacctcggaggccagccctgtccactccactctgtgcctggcttctcttgcctgccttgggccttcgtgtggcccctccacggtgtctgggactgagtgcccctcttgcctcctgaagagcagccatggccacctacaaagtcagggtggccacaggcaccgacctcttgtcgggaacacgggactccatctcactgaccattgtggggacacaaggagagagccataagcagctgctgaaccactttgggagagactttgcaactggggcggtaagagtgtgtgtgtgtgtgtgtgtgtgtgtgtgtctgtgtgtgtgtgtgtgtgtgtctgtgtgtgtctgtgtgtgtctgtgtgtctttgtggccccgggaggggtgaaggtgcgcagggggagccaggtgagctgagcttggcgaggagaggctggagagctgaggcacagctccgaaggcagtgggctccccagtggctctacacgccttgtccagagctggcttccagcccctcgcccatgtcccagatctctgggccatccttctccatcctgctccttcatctctaaccctttcaggcattcctcatctccctccccatccttttcttctctctccctcttcctcagccctctctccctgtctctgcctatcctgcatctctcttttctcaatcctttccacctgctttccttcccctttgctctcctcccctttctgtcttaccccctctcccgcatccctctctcttccattctcagtcactcttcctaattcagctgcctcctaactgtctcacatttgcactggattctctgtgacttaaaatggcatcagaccagcctgtccagtggaaggcacgctttgcgggtcctcagacctgattttcagtcagacccagccacctgctgctaggcgaccttaataggtcactctatctatgtggccattctgaatatctgcatcttcattgatgaatgggagaaggggctggctgggcctctccccactcgaaaactgtagagtggtacccaagtccccaggggtctgaagggttcctgcaacctcaggtgcctggagaggggagtgggagaagacaggagctggggatggagagaaggaggggctggagtcctacatagccctgggtagaggaatccagtaggagacccccaagctggagaagtcagaaggaagctcaatgatcaggtcaatatcctgtccctccgtcagtccagggaggtgagcattgcgcagcatgagcagggcctaggtgaggggccagaggggtgggcggcctgggagccggggtgaagtcctgcccactcagccaggcttgcatcctgcctaggtgggccagtacaccgtgcagtgccctcaggacctgggtgagctcatcatcatccgcctgcacaaagagcggtacgccttcttccccaaggacccttggtactgcaactatgtgcagatctgtgcccccaacggccgtatctaccacttccccgcctaccagtggatggatggctacgagaccctggcactccgggaggccacaggtaagccctcatcaccctgctccatcctatggccgtgaggcctctagctccagcctgctaccctggcatggcacccaggctcccatcaagccagaggggggcccagccccaccagggactcctgggctctcctgccactgtcacacatttccctcagtcagtgctgctgccctgagctcagcttggggctgcacattggaggaagagaggtgcctgaggcccagcagctaccctcagcatccccatctggcagcagacagcattcccagagtgcgctccccgctacatctccagtcctccctgactcctataagatgcccggccatgttaaaaataccccttgtgatgctaagtacaggctcaggactctcacaggaggcctatttatgatgccaatcatatgcgctccagaaagacgccctgttactccagcaggattctgttactataacaggatgccccattattccaaccagcaccttgctatcctatttagaagccctttgagttcaacaggtctccatggtgctgtggtcttataattatgacgccctggctttctttttttgggacggagtttcactcttgttgcccaggctggagtgcaatggcacgatctcggctcactgcaacctccacctcccaggttcaagcgattctcctgcctcagcctcctgatgctagtttttgcatttttagtagagatggggtttcactttgttggccaggctggtctcactcctgaactcaggtgatctgcctgcctcagcctcccaaagtgctggcattacaggcatgagccccagttttctaattgagcattttttagactgatgggatgttctattgctccaaaggactccctattttcccaacaggacaccatatttctctaacaggatgcactgttactccaaaaggccccccttaatccagtaaggatctatctaataggggccctgttattcagatagactgtcagggtttctccaaggttaaggctggccaaggctgcccagtgggttttccacttgcttggttactcccatgggagagacataggaccggagtggctgagctccttgcacccacccctgccagagccccttgtgtggtgggctggggtcagcttcctaatttgtggtgctgcatgaggactgggggcctgtcctctcttatctcccagttccaccacctgagtgtctgttggcttcccttgaggcgaatgggagggaaaggctgagctgaggacacccagggcccgaagccccatcctccctgcagctgactacctctcttccgtttctcattgccctgtgctggaatcttcccccaggattggggaacagggcctgagctggggaaaggagaggcgaggaaagcctgggagatggtgagcatgccaaggggagggtctcactggggacacagagcatcttcctgcagtgacaggtctgggtgacatggaagcaggggacaggcagggtgatgctggtggccaggcaggaatggggttgggtggggccgctgccacgcaacaggacagggagacttgagtcacccatagggccctcaaaggagtgagtcttccgccctggggatgaaaacgagctaggtctctgggttgcacaactccagggagcactgttcatccagaatacaacatgagctgaggcaggtggaggagggagagggtggtgaggtaagggacttgaggggaaatgatgggctgcagcggtaggcacaggccagcctggggaccaccagccagggtgctggagaaagacggacctggacttaggtctcagttcttccgctgactagctggacatttgggcatattttcaaattttttttttttgagatggagtctcgctctgtcgccctggagtgcagtggcgcaatctcggctcactgcaacctccaccttccaggttcaagtgattctcctgcctcagcctcctgagtagctgggactacaggcgagtgccaccacgcccggctaattttttgtatttttagtacagatggggtttcaccgtgttagccaggatggtttcgatctcctgaccttgtgatctgcctgccttggcctcccaaagtgctgggattacaggtgtgagccaccgcacccggccacatttccaaattcttctaagccttggttccctcatctgtaaaatggagataacaacagaacctacttcatagggtggatgtgagaatccaataagatgacatctgaacggagttgttttttttttgttttgtttttgttttttcttttgagacagagtctcgcttcgtcacccaggctggagtgcagtggcatgatctcagctcattgtaacctctgcttcctgggttcaagtgattttcctgcttcagcctccagagtagctgggattacaggcatgcaacaccacacccagctaatttttgtatttttagtggagatggggtttcatcatgttggtcaggctggtcttgaattcctgacctcatgatccacctgccttggccgcccaaagtgctgggattacaggcgtgaaccaccgcacctggcctgaacagaattttaaaaggcttaacaactgttggtggtcagaagcagcccgctacggggcaaatccagccttgtccccacgtaatacataatagcgactgtttctccttgtaaaatgggcatggggatacagtcctttagctgaaactgttgattccaggggtgctttgaaattcggattttattgagaagctacatacacatgtatctgtacacatgtgtgtatgtttatataaaatatgtatatgtatacatatatatcttcatctataaatctatatcacacacataccccatatattatgtgctatatctaccacagggcaccccaatcaaatatactaacacttcccagtaaaaactatgaatagttagacccagtgagttaaataaagattgtatatagcctcagggagattcacagcaggctttgtcaaccaatgaatttgttgtggaacaaacagacaaacttgatttccacagctttctgtactttgcagttgtgacgaaggggtcaccagcctatagtaatagtcacctgcctcatagggtgcttcttaggcttagattaataaaagtaaagtgtctacaaagtgcctggtgttggggaccagcctcaacaccacctgtagggtacccaaagtccggtggtgacgaaggaatgagaagagacaggttaagagtgcaaaaagagtgggggccagggaagcagttgcaaaatggaggctgcaaaaggcccagagttctggtctccacactatttattgagtacagtcacttagatctaagaagcagatgttcagggtgaaacactgaaagggaggcagtgcgtcacaggcgtaatctatagcaatagcggtttaaacgaatctcctttgtgctcaaacagcacatctttaacttatcggagagcagctagtgggaacaggcttaactaggagcctgcgcgtctgtccacattccaggtttcaaaggagtgtctttctccttgaacacagtgtttatagataagacagcaggttaacgctcagagcatgggaccataatggcgataagaacgctttcctcctcagaggccttttgtgacttaccacagcttactgtcacatatttttatggccagtttatacaggcaccccacaagcccttttcccaatacctgggacctagtaagtgctaaacaactgtcagttattaatatttcagtggtatatacccaaaggaaaagaaatcaacatatcaaaaagatgccttatttattgtggcgctattcacactagcaaagatatggaatcaccctaagtgccctaatggatgactggataaagaaaatgtggtatatatacacagtggaatactattcagtcatgaaaaaaatgaaatcatgtcatttgcagcaacatggatggaactagaagtcattatcttaagtgaaacaagccagaccagaaagtcaaataccgaatgttctcacccataaatgggtgttaaaaaatgtgtacacatgggccaggtgtggtggctcacacctataatcccagcactttgggaggcagaggcgtgcagatgacctgaggtcaggagttcgagaccaccctggacaacatggcgaaaccacgtgtctactaaaaatacaaaaagtagccgggcatggtggcaggcacctgtaatcccacctactccggacactgaggcagcagaatcgcttgaacccaggaggcagaggttgcagtgagccgagatcatgccattgcattccaggctgggtgacaagaacgagactccattaaaaaaaaaatgtgtacacatggacatagcaaaacaatagacaatggagactctcaagggtgagaggatgggagggggtggatgatgagaaattacttaatgggtacaatatactttatttgggtgatgggtaacctaaagccctaacttggccactatgcatgtaacaacattgctcttgtactccatgaatttatagaaataaaaaatatttcagtgggtctagaggagggactttttgcagcagcagagcttagcttgacagtagagcaagaggaaagagggtgggtccgtgattcttttatctgatatttccggacaggacgcaccttcactctcccaaggtgagccttcccactccttggtcatgggcccccccagagacgacctggggcacagaagctgaactcctgcttcctgaagtgggcaggggcaagggtcagcccttgagtcctctccttggtctccctacaggaaagacaacagcagatgactcgctccccgtcctcctggagcacagaaaagaggagatcagagccaagcaggacttctaccagtgagggggcgggtggcagagtctgggcgcccggcaggggtccagggaggtggggggcagtgatggctctggccctttgccctggggtggtgcacgggcatgagggtgacatctcggtttcccttgcagctggcgagtctttcttcctggcctgcccagctatgtgcacattcccagttaccgccctccggtgcggaggcatcgcaaccccaaccggcctgagtaaggacccgaagctgtgctgggccccgcccatggttttcccctgggcgcctgcctcctccccgccccctggatcccagttgccctgcgcttctccccacaggtggaatggctatattccgggattcccaattctcatcaactttaaggccaccaagttcctgaacttaaatctccgctactccttcctcaagacggcctccttcttcgtccgcctggggcccatgtgagtgcgtgtgagtgacgggagaacgagggctcctgcaagaactttccctctcccccaaccttggcggcctccaagacagccccagaggttggaatggccaggaaggcagagggagctgaaacgcagacccagaaaacctgagacatgatcccagagacctagagatgcaaagatcttgagacatgggacccagagactttgcgacgcacagaccctgagacccagagacctaagtggatggggcggccccgccacctgccccagccggcgcttggcagcccctctgaaggcctcttcctggaatcccatctcctagggcactggctttcaaagtccgcggcctgttggactgcaaacattcgtggaagaggctgaaggacattaggaaaattttccctggcaagaaatctgtcgtctccggtatggaatggggcgtcccggatcgagcagggggagccaggcggtctccggcgtgctaggcaggcccccgacttcggggcagtgggacgggagaggcagcgaggcgcgcgcgcgccctctggcggcttcttggaaaatgtcgcaccgggctcctccggccgctcagcgccaggctgggggcctcgttttcctccccgactcctctcggtgcccatagtcttcttctgtcccatgcctctccgtccccgaggggggccgggcctccttgtgacgccctcgcgccgtcctcgcagagtacgtggccgagcactgggcagaggacaccttctttgggtaccagtacctcaacggcgtcaaccccggcctgatccgccgctgcacgcggatcccagacaagttccccgtcacagacgacatggtggctccgttcctgggcgagggaacgtgcttgcaagcggagctggaggtgaggcccgctccggcggagaccccggccctcctcccggcctccctcgcgggcatccccgtctctccccacctccggcgcccgcgccagtcccaggcaagcccgcaccccgcgtccctgtccccgtcccacccctgcccctagtcgccagcgccctgtgcacctgcggcgcgggtcacgggcttcccgtgtgggtgcctacttgccacccatcgcggctcccctccagaaggggaacatttacctggccgactaccgcatcatggagggcatccccaccgtggagctcagcggccggaagcagcaccactgcgcccccctctgcctgctgcactttggacccgagggcaagatgatgcccatcgccatccaggtgcctgggctgcaggcggcgctgccgctgagcctctgtgtgcgcgaatgctcctccgagtgtgcgcgcgcttatgtgagcgtgtggacctgcatgtattcagccgtctctcgttatccttgagagattggttccaggacctccccgggatgccaaaatctgcagatgctcaagtttcttatataaaatgtcccagtattgccggacgcggtggctcacgcctgtaatcccagcactttgggaggccgaggcgggcggatcacgaggtcaggagatcgagaccatcctggctaacacggtgaaaccccgtctctactaaaaatacaaaaatttagccgggcgtggtggcgggcgcctgtagtcccagctactcgggaggctgaggcaggaaaatggcgtgaacccaggaagcggagcttgcagtgagcctagatcatgccactgcatgtcgctctgggcgacagagcgagactccatctcaaaaaaaaaaaaaaaaagtcccagtatttacatataacttacacacatcttcttgtgtgttgggatcacaggcgtgagccaccgcgtccagcctgggcacatttttctagttcatacaaaagcccggtatgggctgggagcagctcaggtttgtatgcccgaataggcttaggtggagatgcaccttgcaaggctcaaggaccgccttggcagttccccgcctctcacctgcttgctgtcttggtcccctgaggtacagaagtacaaagtgcgctgctcagcggagctgggtgagctcttgctgctgcgtgtacacaaggagcgctacgctttcttccatgttgcactcctgggctcaagcgattctcccgcctcagcctcccaaagtgctgggactacaggcgtgacgacctcgcccggccctcttgtgtattttcaatcctctctaggcccgctctctaggcccggtgtggtgctcacgcctgtaatcccagcactttggaggccgaggtgggcagattacctgaggtcaggagctcaagaccagcttggccaacatggggaaaccccatctttactaaaactacaaaaattagctgggcatggtggggggcggcgcctgtagtcccagatattcaggaggctgaggcaggagaatctcttgaacccaggaggcagaggttgcagtgagcagagatcgtgccactgcactccagcctggtgacagagcaagactccttctcaaaaataaataaataaataaataaataaataaataaataaataaataaaatgaaataaaatagatcctttctggatttcttatagtacccaatacaatacaatgtaaatgctatgtagatagttgttacactgtattgtttagggaatgacaaggaaaaaaagtctgtacacgttcagtagagacactttttctcccagaatattttccatctgttgctggtggaatccactggtgtggaacccatggatacggagggccagctgtacttgtatgcccctatgtgtgtgcatctgtgagtgtgtgcatgtatatgtgtctgtggggtgtgcttgtctctttgacttcatccatccatccacctggaaaaccaatccctgaagggggtcaggtccctactggaaatactgagataattagacttagcctctgccttgggaatctggtctggcagaggaaggaactggg

SEQ ID NO: 276 - DNA, 10000 bp, Homo sapien
ctctaaaaaacgaatctgggtgaagacaaacctcgaaaaggaaaccaacccacatgcaaacaggaatagaaaatatttttacactctttgcacttcagcccaacggcggtgagggagagagagggtcacctggggcctgtcagcgcaacagaatgattcatgtgaccattttgtcttaattactcagaacaagctgttgttgctgtttatcaagggagagcagatacatcagtgtcttctgacagaaaaagtgatcgccatcaggatggtgatgaccacgatgatccctaggatgacgagcaggatgcggttctggatgattctaggagacagcaaaggagaaaaaacacacacagataagtggaaggccttcccacaaacgccgtccgaggccaggttggctaatcaaacggcagctttgcaggtgggggtggggagcgtgtgtgtgtgtgtgtgtgtgtgtgtgtgtgtgcgcgcgcgaaagagacatcacgcagctttctggttctacaaacgatccacgaggaaacgaaaggctccacatgattgtcacgctgccctccgagaaatgcttactgcaaagctaaggcgaatcaaatggctttcgaggctcagaaaatcatgtagcctctttaagtgatcaagggccccttgcgagcttctctttctaatttaaaaggcgagacaagcctcattttttgcagtgtttcctgttaaagtaaaatactccaaggaaacacatgtcagcaatgtacttacctgcacaaaaatacctggggaaaagtaaaacagagactaaggaagaaaaggatgggattaagaaacaagtgtcaaatgtgcagcttaggctgtgaaaccatcatctgtcagtgtggctcacgctccgttacgctaggaggaaacgttacatttgctccatagcaaaaaagatggaaatgagaaatatacaatgtactcaaggtgcctgttgtgcgtctgttgctgggcctttacctccagggattctacctccctgggttctggctgggctgcacgctgatggggaaccagcaacttagaagggggaccagagtggagacacacgctcccagatgcctgcagagagcttctgatgaggttgtttcataatttgttacctcattcggagaaaagaggtcgaacatcagaatgctttgttgagagtttcaaagggaacctaggtcaaacagccgtgcccacgctcgctctcacagagctgcacggaaatagagacatgagctggctggcagtctagccagctatctgtccagcttaaaaccccacggcaaaccccatccaaccctcctccaaataccaagcagcaaaaggcctgctgccctactccagtcaccaaacactggacatgggtcttccatggggaggagctggggagatgaagctgggctccccacggaacagagaccccacacccctactttgtatcttcacacacaaaaaaatctttgcagggtattttctacttcctagatgagtttatttcctggaaggatgacatcaggttgtagttttagtcagattcctcctcacccatccccttcttctccaaacctaaacggttgaatggaaactgtcttatcagaccaacccactccctcgtggccccctaaaaggacgagctctctctcctcctgacaggtaacaaaatgatcacatttgctgacacgtcttccgcaaaactgccttagtgcctctgtccactctcctcgcaggagatgaatggtccacttggtcctcatttatcactcaaggcttggctaagatctgtctcgtttagttcttcccttccccactagaaagtctgcactccgacattaattcttctgtgatgacagctaattcagacttaacaggccacacttactcaagaggcaggaagattctctgtcccccaaataaataaataaaaacaggacttcatggcttatgatagtgaggctaattatcaacactgatcggtgctacttggtggctctgtttaaaacccaaattgattttttcccccttttctctgggagggacaggagccttcagaatggtccctacacatcccatttgcccaagtcactgtcaaaatctctatttaccacagtcacccgcatcagacttgcaaaggaaatcagcaaaattgaaactcagcagtgaaacagattaaaagcatgaaaactctttaaaattctgccttaagtaatctacagtagtgtgtctcttgtacagcttggttgacaaccattttatttgtgggttgagggccccaaggcatccatgatgctaatttagaaaggattaactgtgggtgttacttgttcaatctgaggcatggtaagaaatatgaatacacaggaatccctaaatcctcagctcttccctaaccttcctaattgggcttcaccccctccttggtgcacccacagggcctggtggcttcccctccaccgcccgctctgttgcttccaagggcccaacctgtgtggactgggaccatgtggaattcacctctaccaccccagcacatggcacagtcgcgttgcacacaggtactcaaaagagaactgcccaaagagtgatcgtgaaagaatgcagtctctggtaactgtaatcttccattcaaaggagaatggagaagtctgtgcaattaatttgcaggaaaatctcaggaagtctgcatggaaaaggttaaagttcaaagttgaagcaagccccgtcaaagatgaaacttcctaccatcacgccttctcagcactacttggtcttccccctgaagctagaaggaactcctttgtgctgggtgggggcggggtgtcagcaggaaagggcatttgctttcaaaccaaatgctggcagacatttgggaggaagagtagaaggggatggggaaagagttggaatagagagagctctaagcaagcttgactggctgggccatccaccccaaccttggacctcaaaggagttgtgcaaatgtgatacccctcaggaccagaaaagtgaactgtcagggcatctgggtggataggactgagccagtttggaagggggaaatacaggctggcattggtgggccccatctgtgaggaagcttagttgcaatcgcagccaggggctgccggcctgtattgctgtaggcaaagcagaaaggaatgcagagctcggagacaatcagaaaaaccagctaggccaaggggttcccagctagtgagatggcagcgaaggaacttggggagaagcccaaagtaacttcctcctaactttgggcaaggggagggctttatgttgaactaggtctgcagcaagccgtcttaatctcccttttgaaaatgcaaagtgtgtttacccagtaaataatttaagaaagaatatacacttgaaagaagacatccattgaaacagccaggctaaattgcctccaggcaaaaacttgtgcatttgcatgctgcattctattaagtgagcacactgtggctttaaaagaatgcagagccaaaataaaaggaatgtgggcccgaaacatcaaggattctccaagtttacattatgaatcacagtgctgttgatacaagatgaattaaccatttactttgaggctgaactcacaaagtactattgaaagtactgatccccatgtggaactcagggagcggttaatctttccattgccagtctcctcccagcctggaaacgagctcctgcgtgtggcagccggaatcacagaaggctggttccagtgcaggggacaggcgcggcactgcacctggcacagttctctgctcttgctcgaggagcccaggaattccactggaacaggcattacgagtgttctccaatagccagttctcctctacttccaggcatggactgcactcatcttttttttttttttttttttttttttttgagacggagtctcgctctgtcgcccaggctggagtgcagtggcgcaatctcggctcactgcaagctccgcctcccgggctcacgccattctcccgcctcagcctcccgagtagctgggactacaggcgcccgccaccacgcccggctaattttttttgtatttttagtagagacggggtttcaccgtggtctctatctcctgacctcgtgatccgcccgcctcggcctcccaaagtgctgggattacaggcgtgagccaccgcgcccggtctgcactcaccttaatgttaggcttggtcatggaactagctttggctaaagaaatgagagcaaaagttctgagtgtcactgccagctggaggcatctaacttccagtgtttgtctctctagcgggctcttcctgcggttttgatttggggagggaggggctgtattgttccagagagtacaagttataggatggtggtaacatcttctgcctggatcctgcagtcattatgtaaagggccactgtcctggagatgcacctggactcccagtggacttgcgttaagccattgaggactgggggttgtcactgccgaataccataagctcttttaccctgagtgataacgctaccgtccgcctctcagacaagacgaggcatctggccaagccaagagaggctctggtttcatgtatttcagaagctaaggtatgatgaagactgataagattttttttttcttgaagaacaggtttttgcctcttggttttcaaaagctgggaacctcttctgacctcttggtcacaacacttttcactgaagaatcaggagcttcttccagccaatgctcctgtgtattgatgactgatgatatcatgcgtgaggcctcaccaggcctagccaggcatccgcttcctgtgtacagcagatctacagtggctgcgttcgtttccctattccaaacagctgatgctaccccagctccaggggtacagctgtgactgaggctgagatggtcagtacattccatgcccctggccatggtaactggaccaggagcaggcttgtgacttaagtccatccaacagagtggatctcagcaactttgcttgaaatgcggggtcacctggacagtttggtgtgtggatgtcaggctggatccactgcaggccttttgattcattgagggaagccaacctaagaaagaagctgacccacagtgggcagagaaatagaaccccagtcctgaagacagagaactttaatttttaactttttttttttttttttttgagatggagtcattctctgtttccaggctggagtgcagtggtgcgatctcagctcactacaacctccccctcccaggttcaagtgattctcgtgcctcagcctcccaagtacttgggattacaggcacctgccaccatgtccagctaatttttgtatttttagtagagatggggtttcaccgtgttggccaacctggttccaaacttctgacctcaggtgatctgcccatcttggcctcccaaagtgctgggattacaagtgtgagccaccatgccaggccgacagtgaacatttttttttttttaaatcaaaccaccctttctttggactttaacttatatgagaaaataaactgactttattttccaaagtcagtttgaattgggttttctgttatttatgaccaaaaagcatttttaggttgagtcaccctgattccaaaaccaggtccttgatctacggcatatgtgcattcttccctcctcttccaagaggcatttcctggctatgtccctctcgtattctcctatctccctacacatctctctttccagtacattgactacagtccccagtaaaaagtggaccttccacagtccgaatttcttttgtcttttgtatccctgatgcctaacacacagcttggcataaatgttctcaaaacatgcttgctgagtgaagaaatgagagactctacctacacgtgctcagggtcacgtggttattgctctcctggtttctaaggactgcttgtagataagcacagctttaggacttagctgttagccactgtcccattaaggatgccagcggagtcccaacttttttacaagcctgtgttcattagctggagagtggcagacactttacaggttcagagcagcatcctgtacctgccttcctgcctggccgactggccctgaataacgatgccccacttttggggtctgacagaacagtaacaattagcaaccgtgagagcataggataaattctgagcagaggaacccggatctgcttctctctaggcacttcccaaaacatgggccaagggaaagctctttaaattctatatccaattcaacgttactattcaccagaaagaaatgaaaacaggagtaggagaaacagttaattgtcatctgcctcaaacactcactttaattggaagggttattttcagagctggggacatgtttgcctctgagctagagctgtgcggttatcatgctgcctgataatgcccatcttgggtcttctatgtcctgcatctctaggagtaatcctcagccccatcgcgagaattcagggaggctgatcccactctgattccacagatggacatatggcccaggcaggcccagccaatgacagctctctagctcttgcactaccatttgctcaaggattggtctgccactcaagccagatggaattcctcttgggattcttcctggaaaatcaagaaaaagatactgtctttactgagattgactgtcaggacagtgagaacctggagctgccaaggaccattcttactaccataccggacgaggctgcctgaaagaagccgacaccagaggaatgcagagccgagagataaagaaaaagagacggattcctgaagacatatttgaacccctgcttcctgctgtgtgcctgaaacctgaagagtcacacttcagcttcccagttacaggagccaaacaattccccattgactgcagcaagtatggttggggattctctcgctttcttttttttttttttttttttgagatggagtctcgctttgtcgcccaggctggagtgcagtggcgcaatctcagctcactgcaacctccacctcccggggccaagtgattctcctgcctcagcctcctgagtagctgagattacaagtgctgccaccacgcccagctgatttttgtatttttagtagagatgaggtttcaccatgtttgccaggctgttcttgaactcctgacctcaggtgatctgcccacctcagcctcccaaagtgctgggattacaggcatgaggcactgcacccagcctcttactttaaatcatactgattgtactggattgaacagtgtccctgcaaattcatgaggttccacctggaacctcagaatgtgatcttatttggaaatagggtcctttttattttttatttttaagagacagagtcttggcctattgcccaggctggagggcagtggtgcaatcacagctcactgcagccttgaacgcttggactcaagtgatcgtcccacctcagcctcccaagtagctgggactacaggcatgcaccaccgcacctggctaatttttaaattttttgtaaagacagggtctcactatgtttcccaggctggtcttgatctcctggcctcaagagatcctcttgcctcggcctcccaaagtgctgggattacagtcatgagctccatgctgagccaccaccatgcccagcctggaaagaaggtctttgtggatgtgattcattagagatcttttttatttttattttttattttttttgagacggagtttcactcttgttgcccaggctggagtgtaatggtgcaatcttggctcactgcaatctccgcctcccaggttcaagtgattctcctgcctcagcctcccaagtagctgtgattacaggcgtgtgccaccacgcccagctaattttgtgtttttagtagagatggggttttaccatgttggccaggctagtttcgaactcctgacctcaggtgatcctcctgccttggcctccccgaagtgctgggattacaggtgtgagccaccacagctggacttcattaaggatcttgagaggaaatcattccagatttagggtggccctaaatccgatgactggtgtccttaagagaggacaaagaggggcacgtgaagatggaggcagagactggaatgatgttgccacatgccaaggaatgttgggccaccagaagctgcaagaggcaaagaagaattcttcccttacacttttggagagagcatcgccctgtcaactccttaacttcagacttctagtcttcgcaactatgagagaataagtgcatttaagccatgttgttacggcagccctagcagccctggaaaatgaatacactgagtgctcggatccagaccagcatatggagctggtgatcttatcttgggtttcgtgatgactgttttccacgtctccaccttcttccccatggctgcactgcacatttactgtggatctacactaagatctcctccaaaggacaggtcagtcccagccgagttcacagaagctttgcatgcagctgtggggctcacagtcttccgaagcttttgattcttacatctcagaataagaattccattcatgagcagagcaggcagtttcctgaagccatgtgagataaggggactgagggggcatgtgccacaacactcatttcacaaaactcctgcctctggaataggccatttaaaacaggaagaaggccaggtacattggctcatgcctgaaatcccagaactttgggaggctgaggtgggaggatcccttgagcttaggagtttgagaccagcctgggcaacatagagagaccctcatctctgtgaaaaattaaaaaaaattaggcaggtgtggtggcctgtgcttgtggtcccagctactaaggaggctgaggcaggagaattgcttaagcctgagggtgaaatcgcaatgagccacgattgcactgctgcattccagcctgggtgacagagtgagaccctatctcaaaaataaaaaaaaataaggctgggcacggtggctcatgcctgtaatcccagcactttgggaggcggaggtgggcagatcacttgaggtcaggagtttgagaccagcctggccaacatggtaaaatcccatctctactaaaaatacaaaaattagccgggtgtggtggcgtgtgcctgtagtcccagctcctcgggagtctgaggcaggagaatcgcttgaacccgggaggtggaagttgcagtgagccaagatcttgccactgcactccaccctgggtgacagagtgagactccgtctcaaaaataaaataataaaaaaaaagggaagaaaactagatgctatctctgggccaatctaccaagccatcatcagccattagtagcccccactggctaacatcaatttaggtgtagtcagtcatccgagagacctgagggactgggacacagtggggatgagttttgatgggcagggagatgagcactttctccagcaaggaactgaggagccacatccactccctgagccctggcatatctagattaggtcctgagtgaggactggagtcgcttcgccctgtttctaaatttttcttaatacttagctcaacaggaatcagcacgctctgtctgcagagggccagatagtcagtatattagtgtgctagggccggcataacaaagtcccacagactgggcggcttcaacaacagaaagttattgtctcccagttctggaggccagaagtccaaggtcaaggtgtcggcagggttggttccctgagagagcagtgagagagtctgatccatgcctctctcccagcttctggtgggttgtcagctatctttggggtcccttagcttgtagatgcattccctcatctctgcctttgttttcacaaggtggtatctctgtgtgagtgcctgtgttcaagtttctccttttaataaggacaccggtcacattggtttaggagcccaccctattcc

SEQ ID NO: 277 - DNA, 10000 bp, Homo sapien
atttgtgcttgcttctgtagttcttttcatagggatgttagagtgttgattttagatctttcctgctttctcttgtgggcatttagtgctataaatttccctctaaatactgctttagctgtgtcccagagattctggtacattgtgtctttgttctcgttagtttcaaagaacttatttatttctgccttaattttgttatttacccagtagtcattcaggagcaggttgttcagtttctatgtaattacgtggttttgagtgagtttcttaatcctaaattctaattagattgcactgtggtctgacagactgtttgttatgatttccattcttttgcatttgcctaagagtgttttacttccaattatgtgataaattttagaataactgtgatatggtgctgagaagaatgtatattctgttgatttggggtggagagttctgtagatgtctgttaggtttacttggtgcagagctgagctccagtcctgaatatccttgttaattttctgtcttgttgatctgtctggtattgacagtggggtgttaaagtctcccactattattgtgtgggagtctaagtctctttgtaggtctctaagaacttgctttatgaatctggatgttcctgtattgggtgcatatatatttaggatagttagctcttcttgttgcattgatccctttaccattatgtaatgccgttctttgtctcttttgatctttgttggtttaaagtctgttttatcagagactaggattgcaaccactttttttttttttgctttttttatttgcttggtaaatattcttccatttattttgagcctatgtgtgtctttgcacgtgagatgggtctcctgaatataggacaccgatgggtcttgattctttatccagtttgccagtctgtgtcttttaattggggcatttagtccatttacatttaaggttaatattattatgtgtgaatttgatcctgtcattatgatgctagctggttattttgcccgttagttgatgcagtttcttcatagtgttgatggtctttacagtttggtatgtttttgcagttgctgggaccaattgttcctttccatgtttagtgcttccttcaggagctcttgtaagtcaggcctggtgatgacaaaatctcttagcatttgcttgtgtgtaaaggattttatttctccttcgcttatgaagcttagtttggttggatatgaaattctgggttgaaaagtcttctctttaagaatgttgaatattggtccccactcttttctggcttgtagggtttctgcagagagatctgctgttagtctgatgggcttcctcttgtgggtaacctgaccttttgtgatcctccaaaggaggatctttctctctggctgccgataacattttttccttcatttcttcaaccttggtgaatttgatgattatgaatcttggggttgctcttctcgaggagtatctttgttttctctgtatttcctgaatttgaatgttggcctatcttgctaggttggggaagttctccttgataatatcctgaagagtgttttccaacttggttccattctccccgtcactttcaggtacactagtcaaacgtaggtttggacttttcacattagttccctaattcttggaggctttgttcattccttttcattcttttttctctaatcttgtcttcatgctttatttcgttaagttgatcttcaatctctgatatcctgtcttccacttgatcgattcagctgttgatacttttgtatacttcacgaagttctcgtgctgtgtttttcagctccatcaggtcatttatgttcttctctaaactggttattctagttagcaatgcatctaaccttttttcaagcttcttagcttccttgcattgggttagaacgtgctccttcagctcggaggagtttgttattatccaccttctgaagcctacttctgtcagttcgtcaaactcattctctgtccagttttgttcccttgctggtgaggagttgtgatcctttggaggagaagaggcattctcatttttgcaattttcagcccttttgcattggtgtctccccatcttcgtggatttatctacctttggtatttgatgttggtgactttcaaatggggttttggtgtggacatcctttttgttgatgttgaatctattcctttctgtttgttagttttccttctaacagtcagggccctctactgcaggtctgctggagtttgctggaggtccactccagaccctgtttacctgggtatcaccagcggaggctgcagaacagcaaagattgctgcctgttctttcctctggaagctttgtcccagaggggcacccaccagatgccagctggagctgtcctgtatgagatgtctgtcgacccctgctgggaggcgtctcccagtcaggaggtgtctcccagtcaggaggcatgggggtcagggacccacttgaggaggcagtctgtcccttagcagagcttgagcactgtgctgcaagatctgctgctctcttcagagctggcaggcaggaatgtttaagtctgctgaagctgcacccaccgccaccccttcccccaggtgctgtgtctcagggagatgggagttttccctatgagcccctgactgggactgctgcctttctttcagagattccctgcccagagaggaggaatctagagaggcagtctggctacagtggctttgccaagctgtggtgggctctgcccatttcaaatttcctggaggcttttttttataccgtgaggggataactgcctactcaagcctcagtaatggcagacacccctcccccaccaagctggggtgtcccaggtcgacttcagaatgcttggtggcagtgagaatttcaagccagtggatcttagcttgctgggctccatagggggtcagatccactgagctagaccacttggctccctagcttgagccccctttccagggagtgaatggttctgtctcgctggtgttccaggagtcactggggtacgaaaagaaactcctgcagctagctcagtgtctggccaaatggctgcccagttttgtgcttaaaactcagggccttggtggcacaggcatctggtctatggttgcaaaaaccgtgggaaaagcgtggtatctggcctggaatgcaccgtccctcatggcacagtccctcacggcttcccttggctaggggagggagttcctccaccccttgcacttcccatgtgaggtgacaccccaccctgcttctgctcgccctccatgggctgcacccactatctaaccagtcccaatgagatgagctgggtacctcagctggaaatgaagaaatcacctgccttctgcattgatcttgctgggggttgcagaccggagctgttcccatttggccatcttcggtgtatgatctttctgatgtgatgttagattgaatttactaatattatattgaggatttttgcatgtatgttcattagggatattggtctgtagttttgtttttttgttatgtccttatctggttttggtgtcaaaattatgctggccctgtaaaataagtttggaagaattcccttctcttcaatttttggaatagtttgagaagaattggcagttttttttctttcttttttaatgtttggtagaatttagctgagaagccatccagtcctggttttttccttgttgggaggctttttattactgatttattatcattactttttattgatctgttcaggctgtttctttttggttcagtcttggtagcttgtgtgtccaggaatttatccatttcctctaggtttttaaatttattggcatatggttgttcatgatagattctaatgatcctgtgtgtttctgtagtatcagttgtgacagctccttttttgtttttgattttgtttatttgggtcttctctctgtattcttagtctagtggctagttgattttgtttattttttcaaaaaaccaactttttgttgatcttttgtatttttaaatctcaattttgtttaattctactctaatctttattatttctttccttctgctaattttgggtttggcttgcttttttttttttttttttttttttgcttttctagtttcttttaaaacttgttttggagactgggtcttgccagtggcttttcacaggccaaattggagtgtgctgtagtctcaaattcctggcctcaaagcaacctggcccgagccttctgagtggctggggctataggtgtgcaccactatgcccagttttttcctagattcttaagatgaatcattcggttattagaactctttttacttttttgatatagatgtttattgctgtaaacttctcttaatcatgcttttgctgtatcacacagggtttggtatgttgtgtttctgttttcatttgtttcaaggaattttaaaatttacttcttaatttcttccttcatccattggtcagtcaggagcatgttgtttaatttccatgtatttgtacagttttgaatattcttcttgttattgatttccagttttattccattgtggtcagataggacacttgatatgatttcagtgtttaaaaattttttgagcttggtttgtgtcctaatatatggtcaatcctgtagaatgttccatgtgctgataaaaagaatgtgtattctattgctgttgggtgaaatgttctgtaggtgtctgttaggtccatttagtctgtagtacagtttaaatccaatgtttctttgttgattttctgtctagatgatctgtccagtgctgaaagtggggtgttaaagttcccaactgttattttattgaggtctatctctccttttagatctaataatatttgctttatatatctgggtgcttcagtgttgggtgcatatatatttaccattgttatgtcttcttgctgaattgatacctttattattatataatgtccttctttgtctctatcactttttacttaaatagcctgtattatctgacataagaatagctacttctgctcactttttgtttctgtttgcattgattatttttttccatcccttcactttcagtctttgtgtgtcttttacaggtgaggtgagtttttatttggcagcatatagttgcatggtttttttattcattcattcattcaacgtcttttaattggggaatttaatttatttacattcaaggttatttattggtaggtgaggacttaactcttgtcgttttattgatggttttccggttgtatattcctttctctttaatcctccttattgtttatttttgtggcttagtggttttctgtagtgataaggtttgattcctttctctttctcttttgtatatcagctctacaagtgaattttataatttcatttgttttcatcatggtggtggttattgtcttttcacttccagatctaaaactctcttgagtgtttcttgtaaggctagtcttcccttagtttttgcatatctgaaaaagactttattttctttcatttctgaggaatagctttgcttatatttaataaagaatattaaagcaatattctttactggcaatatttttcttttagtacattgaatatattatttctttttttcccggcctgtaaggtttctgctatctgctgttggcctaatgggtattcccttatatgtgacttgacgtttttctcttgctgttgttagaattctttctttgtatttgacttttgacaatttgactataatgtgcctcagagaggaactgtttaggttgaatctctttggggactttaagcttcttagagctagatgttcatctcttttccaaaacttgggaagttttttgctgtgatttcattaaatctgttttctatacctttttccttctcttctccatctggagttccaaaatgcaaatatttgttcacttaacagtgtcccatacattctgtaggctttctttattcttttttttttgtctgcatgagttatttcaaaaggcctacctccaagttcagaaattctttcccctgctttgtctaatctgttgttgaagctcttgattgcattttttattttattcattgaattcttcaactctaagatttctgttgggttttttttttttatgttctttgttgaatttctcattcaaatcatgaattactttcctgatttgagggaacagtttagctatattctctttacctcactgagcttccttaagattattattttcaattctttttatggcatttcacatatttccttatgattaaggtgtgttactggagcattattgtgttcttttggaggtatcatggtttcttgttttttcatgtttgatatgttccttgatgttgatttctatgcatctggtagaacagtcacctctttctaatttgatgaaaggttttgtagggaaagacgtatttgtattggaggatcttatagtgtcagttagggggggtgtgttggctttggttctaggtggatgcagtactgtagtgtctgtgcagattcttcagctgtaatccagtctgctgatgtttgtaagtgcccagtggcctaggctgtgagaatttgtagcagtggtggtgcagctttgctggggtgggctcactggattgtttctcaaattgggggcatgtgtgtgaacggtgtcaaccaacttggggtcttgcttgctgggattggggccacagggatgtttctcaggccctgggtacaggcatgctcatttggcctgggggtgtgtctgccagaggtgggccaagtgggctgtttcttgggcttgggacagtggtgtgcctctcagccagccagggggtgtgtccatgggggttgaccccatggggctctttcttaggccctgggcatggtcatgtgacagctcacctggcccaggggtgtgtctactggaagttaatctcccaagctgtttctcaggccctgggcatgggcacagggctgctgggaaggtctagggacatgtatgctgggattgggcccactggactgtttctcataccctagcctgggcacagttccactgggtaggcctggaggcatgtccatggaggtagggggcattgggctgtttctcaggcttaggagataggctggtactggttctggcctgagggcatgtcaggtgcttagcagctcaggggcccagtttggccagctcaagggtaggtatgtatgctttgggagaatttgctagactgtttctctgcctggaagttcaggcaatgatggttggttttcctgctgtgcagaaccagagtcacagccaatcctgggcccaggttctgagcctccagggttgtggcattgcagccacccatgtgtgcttggtggaatgacagagccgctgggctggagaggtgcatttgctactgggccccacagcaggcacctaaggggtggagagtacatatctcatgttcctaatccagaggaatgcagctgtgcaatcgacagtggctctctaaagtcggttcagggcttgtgaggactgtggaattctcctgtagtaaggattgtaggtgtttgcagtggtaatgggggctgatggggctctgcttacgttttcccagcaaaggaaagtttctcctcttgactccaggccagtcagagttgggggatgcaggggcatgggcagcagagacaaggtgtctccatgctgccttctggactttcagtgaccgcagctacccccactgcactccagtgctcttcctttgacacttcagttgaatgttaactgtttgttcatttgttgatcctttcttggggggatgaatgccaggaacctctagtcagccatcttgctgacatcactcttatgtaacttcccttcctcgtcaaatgctgtttttcatatttatccctgccaatagaagtaaatccatttctttacctttaactctgaatagtaagtaatatttcattgtatgaattaattagttttgttccttcttctactaatgacaaattaggctttcctcaaattttttatccttttctacgtatttaagcttctgtagggcctggttcttaatttttttggtgccatatgcctttttgaccctctggtaaatcttctggatcccttctcaaaataatgttcatggaggcataaaatacataaaacaaattatttttaagtaattatcaaagtattaaaaacaaatttataatacaaatgcctataaattacatctattggtaactctaacaactgccataattttgaagtaatgctgaatttagatggattttaagatatttcaatatttgtaatataatttttactaggacagtcccaggtattttatactgttgtgttttgttgcctacattcataattgaaggaaattctaaatttcagctagggggtaatgtttttcccatccaagttcacaaattttaaccatctgtggaattttgttaggtgtgtacacattttgtaattgaaattttactttagtttccaactacactaaaataatagctgaaatttattgagctcttactatgtgccaggtaccatgtcaaaattatcatcccatataatcttcacagcagcacaaagagaggggtgctattttaatctccattttccaaataaggaaactgaggcttggggaggtaaagtaacttgcttatgggtcacacatgatcaaaagagctaggattcaaatcctggttggccaactccaacactcaagttcctcaccaccataatatagaagttgtatttctataatttaaaggggtcaaactaaatttacatgatgataaaggaggttgtagctactgagcaagccaaggggattgtcatgttatgcatgttcataaaagggaaaatcaaggacaaattcagcattaaaatatataatgaatcttgtaaactacatagcaagtcatggggtatagaagacaatgtgaaatacacaattctagtctaattcaaatgtatcctcaaagctccattatattgcatatgtaaaagatgaaatattttcaccttatggaggctgtgaattagataaatgaccagctttctctttcccgtagtaggaaagcctaggcccaaatatgttgtccgtctgttgtaactatgtagatattaatgctatatgtgtatatgaatatgggtgtgtgtgtgtgtgtaatatctcattccttgttccatttatacttactttcttccttttcccctcacttttaatttatatcatcttgctgtattttatgtatccttgtacgtcatggcactggtgtgtatttacatgcatacctacagtacattgctgtggcaggcagaactgtaagatggcccctaatatccccatcctctggtgtatacacaccttctctcagttattccaatcaaatggcgatttagctgctgctttgaagggatttgcagatgtaattaaggttcccaaagtcaggtgactttaagaaagggagattatctggatgggcctgacgtaatttaaaagggactgggcctttgacaaagagaaagtgtgagagggatctgaggtgaaggagattctcaccactaaccctgaagatggagcgggctacatggcaaggaatacaggcggccttcaggagctgagagagagagctcctggctgagggactaaaggagacgtctcttctacaattgcacagagctatcacaaccacttgaattttgaagaggatcttgagctccagatgagaatacagtccagctgatacaatgattttagctttataagatcctgaacagagaacccagctacatcctgcccgaacttgatttacagaactgtgagtaataaatgagtgatgctgaagcctcaaacatcactcaaagtttatgctaattgttatggcagcaacagaaaactaaaactgaatatttattttgcttcacaaaactgcaactat

SEQ ID NO: 278 - DNA, 10000 bp, Homo sapien
cacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacttcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtgactttgacctattctgtagtacaactgtaatagctattggtcttcaagtgggtttagatttggtgacatcagtttgatattctcttaaaggaaataaatattcaagaactgattatgttctaacatgattatattcatggtgttacataggcctcaattttttcacagaaagatttttggaacaggactgtgaagtgaggctttttaaaaaattattttataagcagagaacacagcctgataacttagtcaaggatatactgtctgtctcactactttggacttatatggcttcagattaagtcatccaagaaacatacatacattctaaatggtatatattgggaatatatgcccctttaaaagaatcaggtcagaaatgcaataacaattagactagactgttgcccgtgttaggagaatgtgtggtcatcctagttactaattactctcactcaagatggagatgttgtccagtttaacatagtcttaagttttcttaaacccaaataatttatgagtagcttattacatctgcagagctaccttattataatagtacatttacatattgtctcttttagagtaaggaccacatgattgctttgctttaatttaccactttttgtattgcatccatataagagtgtcttactagccagatgattccatggcaaatgattctctgggtccaaagatcggaaagtgaaaagcacacagctggaataagcaacaactccactgctagttacagctctccgtaggaccaccaaaacgtattcaagagctctaggattccataagacccagagcaaaatggtgcctctctgtatattattcttaagagtgtgctgggaagtcaatggtccatgggtaggcagggcagctgtaactgggctttttaaaacaaattatgagtttctctctgttgccagtagttaaggaagctgaacttaaaaggtatacttttttccttaaaaaaaaaaaaaaaaaaaaaaaaaaaaaatcctgcggagttttataccgtgagaagaccattctgccacttcttttgagaattttttcccaggcattttgaaaacactataggcattgtagaacaccagacaaccccttcttggttgctagactgaactcccaaccttacagcatgtactgacaggtcccctagcctccccagcagttggtcagtggtacagcagacccaggccctgctgggtttccttgggcagaggaattgcccagtacattcattcatctctgcaaagatagatagtcagtgaaaactctgatggtgtacttcagaaaagttggtcacagccaagaaagtttagggttctatttagacctaagatttttctcttgccataagcatacctctgctgagacctaaaataataacgcaaacccttcaagctaccctaagatacttttagaagtcgtttttaatagaactacaaatccttaagtcacattagcattgttaagaaaccactttaaaaagccacatgcagttgcatgtcagatttagaagtattttgtccatgtttaggtatttctaaatcagatgtatttatttaagaaatactttgtcaacaactttaaagcccagcaatttttccaaggctgcctggtcattttaaaataaatactctgcttattcaccacgaatagcctgagacaactacatatttaagtctgtattagggtaggaaccttacccacattccatgttatggaaactatttaatctgtctttgatggtgggaaaaatggtaactatgatctagctattgccatacagttaacgctccaattcctcactgggcttagtagtttagggctcaaatacttatgtttctcatgatgatctttagtggtgatcagggaatccagcttttcttaaaagtttttcctcaaatagaacaatttcaaatgatacacaacttttgggaggccctgagagtgaaatctctaccatggagctaccagagcaaccctgcagatagaagaaaaacatgcactactgctaaggagcagggatgaccacaggcacaggcaaccagaaagcagaaacaggtgacttccagaaacccccgctgccccgtcacgcacctcccgtaacaagaacgcagcacgtcacacagttctcgcgctgctaggtatctagaaacagcagaaagcaagtcctttaaacaggcagcatgttcatttatagaatgagtaaaaagcttttctattctttaacctggatttctcaaccatttttccctgtcctcacacacaatgtcttcatcccaaggccacaacagtctgattcattccaacaaaggtatgtgatctcaaaaataaaatatatacagaagtttctctgtagagctttaacacaaaaaagtactccccattgaacacaaacatttcatctcaaacttgctgactctgtttaaggatgaggaatctatgttttccaatttaaatttaaaacacaatgatgaattttgaatctcgtccctttgtttcttcacacaaaataactaggtacaactatgtccccagatgttctggtctcccatggagctcttcccaaagccatgtctggcgaggggagtagacaaggcctgagataaaccttcccacacaaactggagcccaagcagctgagcacacatttttcccacgaaaggcagcaatagtccttccacgtctcacaagttcttgagatacttggaaagaagatttgccaagcaaaccttccccacactgaaaaatgtttactcagtgtccagtctttgagagagtgttctcaccagagttatctttgacttgagtgtgtgggtatctttaaacaagtcactttttggacccactgacctcaagtcaatgacttagtagaactgcagtaggaaaactggccccatctaaaatttcctatcatgtgttggcctcctgtttgaacactgcacagtcactaatacactgacaggaaaagcacttcagaagtcgggcaactaattctcccttagaaacgtgcgtcctcagtcctcagtaatccactaggggagatggcatgccagcagaaagtcagagaaaagggccctagaaccatccctttgtcctgggactgcttgaaaataagagcacagatatgaggcccttggagggaaaatgacaaaaccaccatacaaagaaagcaaaagagtttattatccacctaatagaattcaactttttggctttaataaagaatcatctcttttaaattaccttcaaaaagtataaaataagtttccagaaatcaactccaggctataaaaaggtcagtttttaaccactttctctacaagaccctctgatcaatatttgtttcctcagaagtgccgagttgaaaaacggctctagggagcacaatttttgtgaaatagaaaccccgggtgcatcacgataaagcttagaaatgagcggatgtgtgcgcactctgaggatgcaggggggagttttaggcaaatctcatcttgacagcaggaaaaattgcctccattttccttggagcatttcctgatttgagctaagggctcatctagaccaagtgagtaaaacaggaaaaacaaaccaaggcaggaggctgggagtgaatgtgctaccatgatttctttccctagctctgctgccactttctgccctgcttctaatgaaagcaagcagggttcgaagacagcatttcactgggctaagatacacctcattctactttcaggtagttgggcgatacctggggagatgggagcggtagttaggtcaggcagtgtctgaaagccaattctgtcagcagttcttccctgaaatgtctccatccacagaacaagtgtaagtaaaagactgcaaatgccacggtcaaataaattcagtggagactataaatggaccagtcaagaggctaaattttcagagcacgatcctctttggaatgtaaaatagagactaaaagtggagagaaaagggattccaaaaagatgtggtttaggaatggatcacagagggtccctgaagctccaccgtaagttcttcagggactggtctcatgtgagtgatgagggtaagaaggaacagaagacaaaagtagtgatggaaaagaacgtgtatcatacacaccgattactggggaatgcaggatatccactgaatcctgaagacccacctgcacacgcctcgccacactcaggccggatgttttccacttgaaagtgactatccatgcctgctccgaccttcctcccaggcttagcatagcagaggaggacctataaagccatccttgttttcaagagccaattgagaggcctgaatgagacctttggtcttacctaggaaatgccggcttagcccagcggcactgtgtgttgttattagtgactgagcagccaatgtctggggcaatttgactggatactccgaatgttcttatgtagagagtaactgatggagaacagattataatccttgcaaagaaggacaccttccccctaggattggctgtaccaggctgtgacttggaggcacagaactagtacccacttctcttaagactttacactgtccaaagaagatgctcttctatgttgtcatgctgagatccagtcccagctttcccaccagcaaagccaggcaagtgggtagggcagttggttcagccaagctgaatacaatggcatggttggtgttgcacagatgaaagggaagagggaacacacatctgctaacagggtgaacagaacatcatttatctaaatagaatagaaataaacaaaaaccttgtaaaacaatcacaaaatttacaaataaattggtacaaaataaataggagagactgtacatctacatcatttgaattataaaatgcattcattaagacaatcagctcaatcctatacatgtcatttgtgcttatttaggtttatgtacacagctctgaatactgtgttcagaaaacttcactgctcaaatgcatgacctgtacactatgatacagtgaataaaggctgaggaggatcaaagtcagacacaaagcagggtcttacttgagggccaaggcaatgttggcactgggcctcaaaaccaagaaaaggcatattaagagcccagataggcaggcagcttccattatccagaaagatggattatgcaatctaaggtaagtggaagaaaccattatcactgtggggccaggcaagtgacctgccttgggaggagggaggccgtggactcacagctgtactgtaccctacataggggaagagagcctgtcaccaagaaaccaccttggaaatatttcatggaggtacttgagaggccctgcccacaaggtaggagacctgcctccatcctcatccaaaacactggtcataaggaatacaggtgggcccaactaaaggggctggggatgctagggccaacataaaagcagcaacctgtttataaaaaacaacactaccctctcacccgccttaaaggacagcagaaccctaggatccatggatgaggaagcttcaagacagaccttgtcctagtcacagacgaagtactaacaggcatatgtacataataaataatataaaataaagcatatacatttgtgggtttaaaggactcaaacaagaaaaaattgataacttcaccttcacagtagattcagacttggggagtaatgatcagaagcgaggctggggctctctggggaatgagaatcctaagacctcattcttcccaactttgctctgctctagaagtctgagcctccaacaaaaaaggcaggcacccaagccccaccaggcccattggatagttctcttcagggtgaatctgcagccaaatctggcccccaaagaactgcatcctaaaagtgaatccatgtggatcagatgccggaaggcgtccttccaagcgaggcaagacaatgctcccattcttctcatttgttcacggtcccaatgggcattaaaacctgaaaaccttgtgtactcaagtctttcttacagtatgtgttggatctgtgtacatataaaccttggcatacaaacacctagaactttactctcttgcagctagaacctttgtttccatgatgcttgaagttcaacctggtatttcccatcaaaagatatttaaaacaattctagtagagatgatgtcagtagctctagcatacagagagaacgtgcttacttgagctgagccaaccacagtggtgtgagaagcaaagaaggtccccagcctaggatggtgggaggaaagctgctccctactctatgcagttgctgtgagctgccatctcttcttcgcatccgtagggttgaccagggactctagaatatgaatctccagataggaaagaaggtagcaaaagggaaatgggcaagtaaaccgtgatcgcagacagaaagcttgcaagtgctagaggaggaaggcctacttgtcacagccttgctaagtaacagcagcaagctattggtgcaccactcacccctcaaacggaggcaaatgaacctcaacttagaagtctctgaacgtctctctcctattaaccaacttgaacacctaagaaataggaaaagataaagatttgcaaatgaccctgaggtataaaaatccactgagaagttgctcattgatacatcagaaaaatttctgaatccccagatcactttcctattcaaacccctatatccctactaaattctgggttaacctacaactcacccagatacccttgatggacagaagcaccactagcctagagcccagaatggaactacatggcccaggacaagagccagtttcctcagtaaggaagtaagcaatggcacctcagaggccttctggaccctaacctaccagctcagtcttgtatttctcctcaaccctttgcaaagaaaagcccgtatctgggctcaaaagcagaggggagtttttcccatgccaccagggagcttgggtcatgctacatagcgtgcaaagccagccctccctggcctgctcttgcttggagccccagagaacaaggtgagcaccttcctgtgccagcccgggtgagtcatctgcctaggatcacccctggggaaccacaggggcaactctggttgcccaggagacctcaccttcctgggcctaggcaaggcgaggatggctacagatccccggctggccttcagatgacagaggtggttgtgtgtttttactaggcaggacacagacttgatcagccagggcctatacgggtctgctcctcaacccaaagagagaatttgagggcagaagttcatggtacctgcttagctcaaattcctattgctctatttcctagggaaaatgtatttctatttgtatctaccattattttcctaggcttggaaaagctggtcctttagtgtacagtgctgacgacagcacaggtaaatatactcacagttactgttccgtattagtgtgaagctctgcattcaacatttgcactgttccttgaagtcacattagaagatggtaagatgccccactccctcccacttggggatgccaaccacttcaacatggcattgaactccctgcagggagtgaggtgaggagggaggaaagaacagagttcaatgtaacctttcaagttcaaattatgtaagaatcaagatttaagccagttgattagcaccccgatatctgtgtaagtcttaagattttgttttcctaagagtttaaatgtatgattttgaatttgcctgacgcatatgggacaagcagtgaagggacggaacctccaaacagcaggagaaaagccctcctcatttacagagcaggcagagtgtcccaggactatctggatgctagggatttagtttcagaggaaccgtggggcaccagtggctgctcaggagcaggtgaggctctgtcccacccagagaggccccgtaaaggagggtgaggcctcccatcagtatccagaactcaggggtctgcatctggtccactcgacccactcccttccacacttgaaaaggtcaccgccgcgggagggcagtccagcggaggtgccaaagagcagccacatcgagaccgcagctattccacggtctttctctgccggaccccactggctttgtagagatgaatggcagaggccttccaagccaaagtcattctcctgctgccccaaagaagcaacagcccagtgtttctcctccaaccatctgagaggttggtttcctgagggaaaatggggcctggaggaggaatctggccgctcagacatgagtgttgtttgaagggtcctaagctctccccaaaggagatgttagccttcattccttcagggacctgacaggaattattttagattccctaatgttataaaatagtgtgactaacagaaggtaaagaataacagaaaatgaatacgaacttggcggctaaaatttcatcctttgggagcctcactgatgccactcctgccgagctcttttataagagaataatttgcaagaagccatcacaccgagcacgtaagacagtattaagaagtctgcttctccctgaagtcagaggcagcagctggcatcccctctcctctccccagactcagttctttaggatttataaaggaacagcagagctctgaaaagggcaccaacacactagctctgattccagaggctctcccagtagcaaggcatccccgagagactgtgtgtggagaagcagacgtgagcccggataggttgacagggcagagttcctgaggccagagaagctgggctaggcaggcttggctccccacagctcagggaaggccagcactgcgcagacccgaagagggggatagatgccctcttccagcatgggctacgctttgctttgttgcaaggacccctcatctttatacactcatcacactggtgttgtgctcagtgagaggcatcttaagaaactgacttttgtatctagatggctctgtttaaaaaaaaggatgcttagagtggggtcccctctaaggtcaagctacgcggtggggcttcatcccacgggggcaggttgcgtgccagtagcaggccactcagcaccctcggggggtccctgtgaccctctacaccaagtgagatcagtacttccccccactaagggacacggcaccttctgaggaagacactccaggactggcatcccagaggaaatactgagccgggcatgcacaacacccgaggcaccaaactgctcaccaggcagccagcccggcccgctgctgtctgctcctcagccacgctccctgccccgcacacagcccagccgtggctgaacagacttcctacctggagtagggagaagaaaactgccacttagccaaggcctccctttgcgcagtgagcctaaacagaaaacgctctctcctttcctagtgatggatgcggcgggcactgataatcttgtgtgta

SEQ ID NO: 279 - DNA, 10000 bp, Homo sapien
catggtcttttctccacagcctctgaagctgggctaaaattctactccaataagtcaaatccccccatgcaaagacaaaacaacatgtcagtgggagaaacaaaacaaaacaaaaccgcccctatttttagttcctctgagatacctattttttttatatatatattttaacacctctgctggcaggaacctatttattttaaatatcactaaactgaagatttaacttatttgttcccatttagtaatacattgcctcaattttctatgtcctctttaaattttaaataaaaagtttgtgttttctcacctcatttagttttccccttttatttgtaaatttatcaactaatatatattgtatatttaataacttccaaaccgtgtactaggcactgcagagctgcaatatggaatcaggggttaccctaaaaacttactagcaaggaagttagcaaatgtttacataaataactacataatacaagatagagcatcaaatgtcttaagaagtaaaataaaggggaaggattgaagaactttgaggaatagaagttttaggtatatgccatgtcagagctattccaaaaagggtgtcttagtgtgctcacggtgccataacaaaatactgtagacagtgtatcactcagggttccctagagggacagaactttatatatatatatatatcctatatatagatatatatcctttatatagatatatatcctttatatagatatatatcctttatatagatatatcctttttatagatatatcctttttatatatatatcctttatatagagagagagcctttatatatatatagcctttatatatagagagagcctttatatatatatagcctttatatatatatagcctttatatatatagcctatatatatatagcctttatatatatatatatataaatgagtttattaagtattaacttaaacgatcacgaggtcccacaattggctgtctgcaagcttgagaagcgaggagacccaatctgaatctccaaattgaagaacttggagtccaatgttggagggcaggaagtatccagcacaggagaaagaggtaggctgggaggctaggccagtctcacattttcacgtttttctgcctgctttatattcgctggcaactgattagattgtggccaccagattaagggtgggtctgccttccccagcccgctgactcaaatgttaatctcctttggcaacaccctcacagacccacccaggaacaatactttgcatccttcaatcaagttgacactcagtattaacgataacagggctgggtgtggtggctcacgcgtgtaatcctagcactttgggaggccgaggcaggtggattgcctgagctcaggagttagagaccagactgggcaacacagtgaaacccagtctctactaaaatacaaaaaattagccaggcgtggcggtgtgcacctgtagtcccagctacttgggaggctgaggcaggagaattgctagaaccaggaggcggagattgcagtgagcggagattgcagtgagccgagattgtgccactgcattccagcttgggcgacagagtgagactccgtctctcaaaaaaaaaaaacaaaaacaaacaaaccataacagacgggttggcctatacaatggacactgttctggaggctaaaagttccagatcaaggtccaacagggtgagtttccagggaagcctctcttcctggcttgcagacagccactttgtcctcatatggactttcctctatatgtgcacagagagagccagctctctggtgtctcttcttttttttttttttttttttttttttttttttttgagacggagtcttgctctgtcgcccaggctggactgcagtggcgcgatcttggctcactgcaagctccacctcccgggttcacgccattctcctgcctcagcctcccaagtagctgggattacaggcgcccgccaccacgcccggctaattttttgtatttttttttagtagagacagggtttcaccgtgttagccaagatggtctcgatctcctgacctcgtgatccgcccgcctcggcctcccaaagtgctgggattacaggcgtgagccattgtgcccggcctaggtgtctcttcttgtaaggacactaggcgcctggatcagggccccaccctgatgacctatgttaaccttaagtacttccttagaggttccatcttcaaatacagtcaccttgtgggcttcaatgtatgaattttggggagacacggacattcggtccccaccaaagggattgaaagataagaaagaagccaggcacggtggctcacgcctgcaatcccagcactttgagaggctgaggtgggtgggtcatgaggtcaagagttcaagaccagcctggccaacatggtgaaaccccatctctaataaaaatacaaaaattagccaggcgtggtggcgggtgcctgtaatcccagctacttgggaggctgaggcaggagaatcaatcccaggaggcagaagtttgcagtgagccaagatcatgccactgcactccagcctgggcaaaagagcaagactccgtcaaaaaaaataaaaataaaataagaaagaacaaggcattctactggagagaaaagtatgaggtgaggttggaaagggaacagcatttttggaacaccacatggttgaatgtggttcaatagccaatgaagaggaacagcagaaatagtgttggaaacttggttggatgtcagtttgtggtgcgttgaatgccaagtttaggactttagatttcattctgtaggtatccaggagttatagtaaaaagtttcaagtagaaaggctgtattacaggaagattaacctgacaggtagcactgcaatgatgttgaggtcctgccgatctaggaatttaggaaactcctgccactcaaagtagaaaaaacctaaactgtttacaatgcactttctcatatattatcttggactgaccttcacaattagaactaagagctatgccacttctccagccatatgcaggacaaagaaccaaagctaactatctcatgtcacaggagccagaagaaaaccaaggtggggcatcacagcctctgttcaggaagtccacacctggattggcaatactactgctgtggtctctgtagtaatcttgaatcttaaagcaaatgcaaggtttcccaggttggcctggactcctgatcataggccagacttcctgatactaatttttttaacttaaaaacatttttgacatataataaatacataaaagtgcataaaacataaatgtacagtataatagctgaacacataacatatcatctaaaacagaacccctttgaaaatgaaaaaaggctactattaatatttaacctggctgggcatggtggctcacgcctgtaatcccagcactttgggaggccaaggcaggtggattacctgaggtcaggagttcgagaccagtctggccaatatggcgaaaccatgtctctactaaaaatataaaaattagttgggtgtggtggtgggcgcctgtaatctcagctacttgggaggcagaggcaggagaatagctggaatccgggaggcagaggttgcagtgagctgagatcacgccgctgcagtccagcctcagtgacagagcaagactccgtgtcaaaaaaaaaaaaaaatttaacctggtttgaggcttaaactgggacagccccaggcagactatgttcacttgataattatcatggtaaaggtgaccaccccctagtcaagaaaacccctatatatcccttctagaccactagactacacacctctccctctaatccagatgtatctactatccttactttttttttttttttttttttgagacagattcctgctctgttgcctaggctggagggcagtggtgcaatcttgactcactgcaacctccacctcccgggttcaagcaattctcccacctcagcctcctgagtaactggaattacaggtgcacaccaccacgcccagctaatttttgtatttttagtagagatggggtttcgccatgttagacaggctagtctcaaactcctaatctcaagtgatctgcctgcctcagtctcccaaagttctgggattacaggtgtgagccaccacacccctggccactatccttacttttatagtaatcatttccctttttagttgctatattcttaaatttaggaaaattccctaaaggaaaacaaggacaaaccatttaatacaatggtataagagtcagaacaagttctggcctttgttctaacatttattagaatgtgatcccggccaggcacggtggctcatgcctgtaatccccacactttgggaggccgaggcaggtggatcgcttgagcccaagagttctagaccagcctgcgcaccacaggaagaccctatctccacaaaaaatacaaaaattagctctgtgatggtggcgcatgcttgtagtccctgctactcggaaggctgagatgggaggatcacttgagcccaagaggcagaggttgcagtaagcccagatcgccccactgcactccagcctcggtgacagaacaagaccctgtctcaaaaacaaacaaaaaaagtgatcccatcatttaaaccatttgaatatactcagcctcagttttctgtaaaattagaaaaatcagcattgtgagggaggcataagggagtttagtaaagaaacaacgtggggtatttgtctggtttttatctcacacaaaccaatgaatcttcctcataaccatgagaaatcaccatctttaaagggttgcactggcttcatgggctcctgctacattatttaaaagcaaaaataaaaatacctccttcatagcatttccttagttagatccagttgaaaggaataataaggttaattttaaaaagaaaataaggacagttaataaaagattaactacaaagcctagaagccacacgaatcattctgcacttgctgtgcaaacctctcctccctggcaacttgacatttgctttccagcgtaggcttatttaatattcacaaagaaagttatgtgatgggagcttgttaactctgagaacagagagtaaactgtccaggccacttcacctgacacaattaggctctgagttgtaggtcacattaccataagcagctctagcactctctggtgtcctcctgcgagcgtccctgcaaagctccatgtgcccttcttggctactgcttgtaatgaattaaatatatgttagtgtcatagattaggtcactgacttccatcatctgaggtatgatagaaaaaaacctcacttgtaacattgatgaaactgtactaattctaatacttaaaaaagggtcacaaactcaaaggcctacaggggtgagtgaagttgacttgaggtggggatggtggcacactgtctaaagtgacatgccctgtctgaaggggaacccattactcagccatggccatcacaactatgcagaaatgtagggctgctgttgccagcattttcaatttttcaagaagccccaaattcattcatatatatatatatatatatatatatttttttttttttttttttttttttttttgagacggagtcttgctctgtcacccaggctggagtgcagtggtgtgatctcaggtcactgcaacctctgcctcctgggttcaagcgattctcctgcctcagcctcccgagtagctgagactccaggcatgcaccaccacgcctggctaatttttgtatctttagtagagacgggtttcaccatgttggccaggctagtttcgaactcctgatccgcccacctcggcttcccaaagtgttgggattacaggcatgagccactgcgcccagcccaaattcatattttatacagaattttctgatttataaatgtgggcaactgattgtaaaaaattggaaaaaacactgtgacctccacagaatctggacccataaatctgtttttacatatggaagagaacttgagagtcttccaagttcaatgccttcacttgacagatggagaaagtgaatcccaaagtggacaaatgatgttcctatggccaaataactagttcagcggcagagccggatctaaaagaatacttgcttcctgtctcctgcatcacttttcactccaccaatgagaaaaaggttagtggctttaggcctagtttaaaagttagagatgagctcactggcatgtgcctgcagtcccagctacctgggaggctgagatgggaggatcacttgagcccagaagttcaagtctggcccagacaagatagcaagacctcatttctaaaaaaaaaaaaagttatcagacccaagtctggattacagtgtgcctagaacatcattgactggccagtctacatttttactctctctggcttatgaggcatcatgctactatatgaggcaatgaagtagtattaagccagaatattttggttctaaattgatctcccccctcacctggagcattgcactgcagcatggccctgccacatggaaggtggggccaccatgttcccactgcggaaaggaattgttacaattgtgagtccaacacaaccaaggctcactcagcaggaggaaattaagtacaaaacttacattcgcataacactcctattaacctcagtgggagttgtgctttcaggaattgcagggtcagcagttgaacagaaactggaatgaagcagtaaagctcatcataggttgttgttaggattgtataatttcagcttcatatttgcaaaagaatttttttttttttttgggagacaaggtcttgctctgtcacccaggttggagtgcagtagcatgatcatagcttactgtaacctcaaaaagagttcatttttactctagtgagatctccctctactgactctcagggcagggcctacagaagaacctttgtttggacccaaattgtggtgtgtggttgaagaaaattggcaaatcacagaagtcaggacaggtaccaacaaagtttagaaaatacactcagcagtttttgtcctcttggcccatggggttcataatattccattttagcaaccagtgcctaggacagtgcctggtacacaggagataatactatttagtgaatgaatgaaagaaaggatagacagttcccataccttgccagactcatttaatacaattcccatcttaacatggcagaatgagtgactacctcagctgcttccctggagccatccaagtaaaggccaagaataaataggaggagcaggctctggggctgtcttggcacaaagccatgcccttttcagctatgcatggctggatgtgggggtgggggcctgttgaggctactgctgggcctccctgagttggtaagctgaaaagtttctgcagccttccatgattctttttttttttttttaattttttttttttaggctgggcacagtggctcacacctgtaatcccagaactttgggaggccaaggcaggtggatcatgaggtcaggagtttgagaccaccctggctaacatggtgaaacctcgtctctactaaaaatacaaaaattagccaggtgtggtggtgtgtgcctgtaatctcagctactcgggaggctgaggcaggagaatcacttgaacctgggaggcggaggttgcagtgagccaagatcatgccactgcactccagcctgagcgacagagcaagactccgtcttgaaaaaaaataaaaataaaaaaatataaaatttttattttttagagatggggtcttgctaagttgcccagcccaatcccattactcaacatctttttggggaactgagagttcagaaggacaagtaaaaagctaataccctctccttgtaaatgccaaaaagcccaataaaccaaataaacaaaacacccccccccttttttttttctgagacagagtctcgctctgccacccaagttggagtgcagtggtgtgatctcggctcactgcaacctccacttcccaggctcactgcaacctccacttcccaggctcagccgagtcttgtgcctcagccacctgagtagctgagattataggccttggccaccatgcctgtctaatttttgtatttttagtagagacagagttttgccatgttggccaggctggtcttgaactcctggcctcaagtgatccactcgcctcagcctcccaaagtactgggattacaggcatgagccaccacacccagccaacagaacacccttcaatcaattccccccaagcagggccatcttgtgttcatgaagagcaaagtatgcttattccagctgtaccattgtagctaatgctgtaatgtaccattttcacattaaagtaggttacgactagatagatacggcaccctagaaccaagcaagcatgtttaaaattaaggtcatggaggtgaatagggcttaaaaaaatactacctagttctttcctctgtctgtaatagtaagttaggctctatagctgaacctactcaaaaatttgagaatttctccatattaaacagctttcttaaaacagaagtctatcctacggaatccattccaatgttttacatgccttaaaattctcaaacccctagtccgaaatcccctggaccatgccatgcccctggttgtttttgtactgagcccagggcaactggttgacatcttatcaaaacccttgattggttgaaggctatttatttatttatttgtatttattgtttttgagacggagtctcgccctattacccagcctggagtgcagtggcgcaatctcgggtcactggaacctccatcccctgggttcaagcaattctcgtgcctcagcctcgagtagctgggattgcaggcgtgcaccaccacacccagctaattttttgaatttttagtagcgatagggtttcaccatgttgtccaggctggtctcgaactcctgaactcaagcaatacacccacctcggccacccaaagtgctgggattacaggtgtgagccaccgcgcccagcctgaaggctgttatttaaaaactgaattatccagctcctgatgataatgaccatcacttatacctttctgtgtcctccaataaagtcttcaagtacagctggaattcaaattatttaccatccttgaacctttctttaatgttcttaatattcttctttaactatggaaaaactgaatctatcattttgctaaaagtttaaccaggacaccttataaagaaaaagaaaacctaccatttttacatctctttcctccctcccctcccttcctctctccttcccttcctctctctctctctttctttctttgacagggtctcactctgtcactcaggctggagtgcagtggtgcgatcttggctcactacaacctccacctcccagattcaagcaattcttgtgcctcaacctctcgagtagctgggattacatgcacatgccaccacacccggctgagttttgaatttttagtagagatgggggtctcaccatgttggtcaggctggtctcgaactcctgacctcaagtgatccacccaccttgacctcccaaggtgctgggattacaggcgtgagccatcgcacccagcctatttatttattgttttttagagacagggtcttgctctgtcacccagctggagtgcagtggtgcaatcatagctcactgcagcctggaactcctgggctcaagcgatcctcttgcctcagcctctccagtagctgggactacaggtacataccaccatgcctggtcatttttacatcttttagctctctttttaaaaaacgatcgaactctattcctgacccagttaggataatttacaataaataatcactatgtcatcagtcattagggtgagatacttatgattcatttgttttcttgagatacttgattcaaagatgtt

SEQ ID NO: 280 - DNA, 10000 bp, Homo sapien
tcataacgttcaggaaatggtgttctggttaactagaacaatttctttttgttttaacccctagtactgaaaatagttttattacctactagttcattttgttctgacttgggaataaaatgaataaatgaatctgacttaatgtctttgataactgagactctttcattgcctgggaccattttcaggacatgaattcttattctacagtactgtggatatagatgtaacaggagattataatctacaaaattaaaaagaaacaacaaaatgtcaaaatgcaaatccctgataccagcttattgtgttattatttgatctcttttctgaaaggtgaagggatacattttctattgaggttctggttactcatagttcaatcattttgaaattgttgactcccattctgttccataaagaccagttaagagattataggatttcttcatagtttctaatttaatccctagaaagatttgaataatgttagagattactgtaatctatgtttttaattaaatttttaaaaatcagtaaaattattttttgggaaaaaaacccttgtgtttaattactaattcattctagatctatacaaaataaaacaaaataaaatataaatacaaagacatgagaaccagtaatatttacatgtttttaatatgctttgtattaatattcaattttttaaatgaattgattacttaaaaacacattgttatattcatatgctggataattctcagtttgctgctgcttactctccattgattttggtgtcataaattccatgtttcatggaatttagaattttgcattttctattttggtttcaaaatcaaattggatacctttacataaaatgagtatatttagttcgttcaaagaaacttcaacaccagactgctgtagggggccaactgagagtttgttgaatagtaagaattttcccatggtaaaacaaatcattttggacattctcttggtagcaagcactgatagaggagtacaaagattaatttaaaaagtttcactataaacaattgccagtcacaatctcattttagaagtaaaactttaaaaatttaatttaattctaaaatttaaaggggctaaagattctttgttaaatttgagtgggtgtaaaatgaaatttaacaactaattataaaaataataacttaataattacagctatttaatagcataacctgtaatagaaattggtttatgtttaaataagttctatgacttaaaggaagactaacattttcagatattaatgagggaaggttttacaactgagactcccgaagaagtttgtctttctaaatgttcatatggcagggccagattgaataattacagtttttattataccttgcaacgatgaaacgacatacatttttgataactctccttttgcttctccaagaatggcaaagatttacagttttatacaatgaatcctaatcatccaaaaggaaatttattacacagtaatgtgaatagaatttcatttatgaagcttattttttcattctcaaatgatataaacaatgattaaaactctccttctggatctaaacagcggacttttttttccctaaaattctcagtctcagcgttttgattcctgtgggtaaagaggaagacgtgaggtatcattcccccatactggatgagtaagatcatctattcagagtaactaagcaaaaattcttaaccagttcaactacggaaagtcttgaaatcttaaaatcacaattttggttttagtctgactgattattcagcaatccccacatttgcgaaactgtagagaggggcaagtagttaagacttcagcatcttctttactcttgattataatttaatatacttaaactttaaatatgaattgctttccctttttacacaagttataaaaataagaggccctgtttacacagtttgcatttttatgaaatttgcagtttgaaaaaaaagctttttaaaaagtggtaactaatgcttttctttgaatatgctgtaaccttagaatttttttctgaaatagtttctcaatttaacccactaaacatttgaagatagagtttttatttagcactagagtaaaacatactaagcattgaagaaaagtaagtttgtttctttttcttctggttccacttaagtttctttaatatgtggcaccccctttatgacagctatcaatattatatttaaattttatatattgacaaaatgcaatctacctctgtaagcattgtgccattcaacaatactactattaaatttacataccacagtttaaattacatccatttcaggaatggtaaaatgctaaaactcaagtgtctaactgccttactggaatgagagtacaatttacaaatacaataattacattttaaaaccattaacaatattacacctagaagtaaatactgtaggactggtcatcatggtagtgtgtgagggaaatcacagatgaaagtcattgactttccacctgatatatcccaagtgcagatattggtttgttttcatcaaaccaaaattaaaatctgtttctcatacatcagttctccattatatgaatcctccaaatccttgcataagatttcattagttatctgccaagtattttcctgcaaaacaaaacagcatgtcaacaggttatctggtagttcaataatgtaattattatatgggtaacttttctattcctccttccctacccctaggagccagatactgcatacttcagaggtacaatacgaataaaagatacataaagtttccaaatcaattttcagtttttcagatcagctagttgcctcttcacatttccatagatcaacaatttgcagaggtttggggtttgcccagaatagattgggagatttatttctggatgtgagaatccaacttatgttagaaagggtgctcataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggtgggcgcctgtagtcccagctactcaggaggctgaggcaggagaatggcatgaacccaagaggcggagcttgcagtgagccgggatagcgccactgcactccagcctgggcgacagagtgagactccgtctcaaaaaaaaaaaaaaaaaaaaaaaaaagaaagggtgctcatataacttatattccaatttggatcatttttgagagcgaaaagggtataattaataattacatcagtacaatagacataaaaaaaccaggatttatcccagcaaatcactgaaaagtataatcactctagtattagagagttcctctcccccaattgaaaaacaaaataaaaccccattgtttgtgccaaataaaacctgtctcatggccacattcagcttatgggtgaccagttttgatctgtggcctagattctttgagtttgttattaaagtgaaaaatagattctcccagatctcagctaaacctgacaagtctaaactctgtgaagtcctgtcagagaacaaaaagttttctggtgggagataaattaaaaggcaaggctgggtgcggtggctcaccgcctataatcttagtactttaggaggccgaggcaggcggatcacgagctcaggggttcaagaccatcctggctaacacggtgaaaccccgtctctactaaaatacaaaaaattagccatgcgtggtggtgtgcgcctgtagtcccagctactcgggaggctgaggcaggagaatggcgtgaacccgggaggcagagcttgcagtgagtagagatcgcgccactgcagtccagcctgggcaatagagagagactccgtctcaccaaaaaaaaaaataaataaaaataaaaggcaaaaagtatttgtcttgttcgtcaatataataaaagtaggatttactccattaacctcagtatatacatctatataatgggaacaactagccccacttaagaaacagagttagaagtcagagcctcctgacttctgatttctagtgcattgtcctatttctacttcattcaataattggttggttttctaattgggatgggggttgggagtgggaaagaggtggaggaaaaagatgagaaaatcacaacctattcctcttaagagtagccaaggcaacattattttcgcaaatgaaaaaatcaagatactcatttacctgcagcaaaccttttcttgatgagtgaaaatcgataccctgctccaacaagttcaatgtcacagccagaaagggtgcttccttcacttgtgaactgcacaaccaatggagaaggtttgcttgggccttcagataactgaaatcttgccaacaaagaacccacccctaaaaaaaaacacattattacaaggtaacagtcaacataatatttcggatataattttggaggttgcattcaaaagttaacgtacaaaatcagacatgattctttgacaaaatggtgattaaatgagtttatcattgaatattatgagcaattctatttgcacactggtaaaagtgtacttccatgagatggtacctcaaaatttgaagacgtgctacttggaagcccttgtattttccaacctatgattaatatctgaggagagtgaaaaatatctaatcagggagcgtggaatctgacacaggatggaaacatgcctccttaagaggcctaaatgatagtttgtttgatgtggagtctgtagaaaaggggaaaaagagaattcattgaagaattatttgcttttattaattgaaataagtaaacgcaaaaatggagtgaaatattctgcttgtttttattgctacatgttttgggtaatagttggcaaatacctaaagccattttagctttacatgttaaataaaataaacttgtgattccattacctccattttctgacttctgagagatatcaggaatcttccacaatattctctgttgttcagcattcctaaaaataaattaggtaaaaggtttttgcatatccaagagtttttgtttactggatgccatgttttttttccagatagtattaattttttaaaatagagcttgaaaactttcactacaatttaaaaattccctgtctctctctctcccctcccagacatacataaatctcttttttcctctgtccttattgtaactagctagaacaccatgagatgaacattgagaggacaaagtagaattaattttttttaaaataaatctgctaagacagatacatgggaagataggagtgttaatcaattaattaaggtaatttaaattggggtcatgatctggctgacattcatttttaaaacaaattccactttttgcttctgacagtcgtatggaaaaagtgaaatgctctttctagaacaagtcctttataatagatgatataggcacaatgtatctattcagtttctagtcccataccttctctagtgtgcctttttatagttcagaggctacaaaatgaaacactacatttctcagaggcctttgcagttagggtcctaggtacaaattaggtttaccaattgcatgcacggtttgagatttagaagacagaagggagacagaggccattctcctgcagctttcttgactgttttcctctgatcagcaatctaactcagatgtggggatcttctaacaacaggagtccactctagcctctagtttgtgggtgccaagaagcacttaaggaggtaccaataggagcttgctggtcctaggatcggaattacagctgtggcttcctgaattcaatggttctaccggtagccttctactttctctccttcccgggattgtggcaggccagttctgcagagctctgggaggcatttttggagatccagcctgttcctttagcacttccaccattgtgtaagcattgaagtccctgttgaattagtttttgcttaaaatagctaccagtggtttctatttcctgccctgaaccctaatgcacaggcctgctgtcatctcctcctacaggacacgcaagtgctaaggagtctgtgacctcttgacccagaggagccctttggtggagagaataggaggcttcataccagactgctggtgggagcactgcctggagcttggtgactcctccgtcgatggggaccaggaactgcacattgttgagggccacagcagtcgtcattgcatctgtattatatttgtaatctatgcgcaggtcagtgcttgaaggctcacatcgccaattcactgccaggttcagaggtgtggactgaatgccctgggcagacaccttgccgaacgacaggaaagaaaataacaacatatgacagggatgttcttagacatcaaacaaaatgtcatatgttgtttatgctgctcacaagcaaccgtgagtgagaggcaccgtgaagcgtgctgtgagagagctgggtgcttcaagtaaactgttacagactaaaaacacgaaagcagctattagagtctcggtggcactttggagttttcagtacacttcgtgtcagttaaggaggtggaatagcatgctggccaggagctgaggccaggaagctagacagtcccaggtgtgagttctgattctgcaactctacttacaagctgagtgatcttggacaagtccctagctcagaacctctctgagcttctgtacttccctcatccgctaaatgggaattacaacaataatatttacccatagggttgtcaggaagattgaaggaggtgtttttttgtgaaacactcagcaggatgcctagcacacactaggaatacattttgataaatgtcacctattaatattcttaccatatttgctcttcaacaacaaaccagtgagttagactagggtaggttagtattactcctttgggatttcacacctggtttcaaggccttgctttggcaaatcccaaagggagtaacaggaagttacttctagtttttacttcctttgggattcctttagctggaagtgctacagtgctagaatctactgtcgatactaattagaatcagctgtgagcttgaccaagaaaaagccaggtttgaagaatcaacaaacatttatctaaagacaataatattgatgtgaattctgggtccacagtgaaaaattcacagtgttggaatttctcgattgttcgttatggtggtgaataggtgtctaagaaagtcacttctcacgagtacatgtacattgcagggatcagatgagtggtgtctatgcccttggatttttattcatggactgtgatgagctttgctgattttgaaggatataaacaactgtctaggaaatgcctgcacatatgatcaccatggagaagggtcctgaaggtagactgaactctcaaggcaggagtggttatggcagaaacaagcccccaaatggattcttttataaaatgacagatatggcttttgatgacaatttaagctagttaatcattatagtttttaaactttaaatattattggcagcataatgctttctgcaggcaaacatttattaagaaatctattaactaaagcagatcaaaagcagagcagaatccccctcccccacccctttttctggactctgtcctcagcagtagttctcaacctgattatagttcctctacctggggaggtgctttgtggatatatgaaaatgtgtttttgatcgtcccaatttctggggggatgctatcgggccagaaactaaacatgctgcgatttaagggccatttccacaaaatgctagttgtgcttctccacccaattccttgcattgttgaaaaacaacaacaaaaacacagctaaacaacagcaaaagggattcctcagagaacatgttaaaataaaacagcaagtctaggactgttgacatttcacaaagtactttggaatatattaggctattattagcttcttatagcaacctataaaataagtagatatcattattacccttatttgtagatgaggaaactgaagttctgggatattaagcacctgaggtcagtggccagtagaaagctgacttaattctagaattcagtatcttgcctacactttatttatttattttaaaaagtagagatggggtctcattatgttgcccaggctagtctcgaactcctgggctcaagtgatcctcctgcctcagcctcccaaaatgttaggattacagacatgagccaccgtgcgcagcccttgcctacactttaatactttacacaaagctcatactgcaataggtgaattctaatttctagatttacttaataacaaatacggaaatgaaaaaaactctataggatttaataatttaaaaaatttttttatctgaagtgaagatgtacatgcagtgtatataattagagtccacgaagggaaagaagtgccaacttatttgcacactttggggatgcaaaccatacatgaaagttaacttctgcctcgaaatttaacttctcattcagagaaaaaattacatttagagttttcctttcttatttcctttcatttctcccaaagcataaagcagtcactaagcatgtttaaatattttgggaagaagttaaataaaatgtgttttctattatattttaatttgtaagtgatgaatttatgccatattatatattttttcagtattatccataatgtttgaagagtatatactattctcacaagaaaaaattatattcttttgcatttctggaaaatacaccattttatagatatttcactttaaatggttttcttacaacaatttaaataaatgttttccaaagcagaggatgcatagactcccttgagaaacttatacaaagtacagatacctgggtggcattctaaaccaattaaataaaatttaaaaagtatatttaatatatatatctgctaggtcctaacaccccccaaaatacatatatgtatatttaataatgatatctacctatatttacatataatacgcaatatattatattcacatataatacgcgatatattatattcacatataatacgcgatatattatattcacatatacgcgatatattatattcacatataatacgcgatatattatattcacatataatacgcgatatattatattcacatataatacgcgatatattatattcacatataatacgcgatatattatattcacatataatacgcgatatattatattcacatataatataatatattcacatatattatatatgatattcacatatatcatattatattcacatataatatatcgtattatattcacatatatcatatttatatatttgcatattttatataatattttaaactatttgtataaatatttatatttaaaatatttgtataaatatttatatttaaaatatttgtataaatatttatatttatgaatataatgtgttattttatatgttatagattgtataggttttatatgtatctaggttgtatatgtaaatattataaataaatatttatattatttaaatatgtatacacatatatttatttttagcatcaattcagaaccagcatttgattgagaaatacagtcaagtttgagatgtcctgatttttattaaagtacaacttccttcatttgaagaaaaataatctgaacatatttaataaaaaattataatgcattaaaaacgtggtaaatgaaatgagccaggcacagaaagaccaataccacacgatctcactcttatgtggaatatttaaaagttgatcttggctgggcacagtggcactttgggaggccaaggaacggggatcatctgaggctgggagttcaagaccagcctggccaacatggtgaaaccccgtctctatcgaaaatacaaaaattagccaggatga

SEQ ID NO: 281 - DNA, 10000 bp, Homo sapien
agagaattacagacagcgaacttgcccctaagccctcgttgtgggtttgtgtttgagcatttaggagaggactccagtgctcctcagcgacagacacagctgcctctgcggtgtctgaaggccctggtcgtggtgacgctagatggccgccctgggcgcctcctgtgggcgtagaggcatcaccactctgcactggcagactcagcatggagttggagcagagtctgacacgagcacttgccatcccaggcgtttcagttctgactgagaaggtagatgcacaggggaggagagggccctttcgagctccactctgcctccaccactcattccctaaccccgcagcctcagcgccctcatctgtaaaatggggagttttgcctacagggttcagcacaatgccagcctgacataggaaccccagtggattgtcagttttgccattatcccctgcatcctggaggtgacaccgcctggttaataggcaacactcccgacggcccagcacagccccagggcagcaggaggctggcctgtggccaagaatgcatggtggagggggcctggagggggactgcagctcctcctcttcctgcttcctccctgctccaccccgtgcctagggcagcacaaaagccaatcgctagcaaactccctgcctagcaaggcccagcctggggcagaaatggctgcaagtggccgaggtctctgcaaggctgtggccgcctctcccttcccggcgtggagacgagataacacggaagccaggggaggtctgaagcctgagtatgatgcggtggtgataggagcaggtaaagtggtaaagcaggccgggccagagctgaggggcgggaagacagccctgctcagagcttggtggggagggggagggggagccaagccccactgctctctcctctggcataacccagccagaagtttatacgctagcaggggctgcaatggaaagcccttccatctggcaggcaggcacctgggattccggtgctggctctgctgtgtggcctggggcaaatgcttgccttctctgggcttggatcttcccatggagaatgacaggaagactaggtgagctcaggggtttccctatatctcttgcaaagtgacctagtttccaccacattctcagcctatggtttgtaagggttggaaagagccctgggccaacagacaagtgaaatccagcaccccgccccctcagtgccctgagttctggtcaccactaccttaccactgaggccacccctcgtcacaagaaactgcagtcatttcataaaggccagttaggataaaacagaactgagtcccagagttcctactgcgtgtctgcagagggagatggaccccattgccttgcagctctgggacatttggggatctgcagtgatctgccacactttgccaacccctgggctcagagtatcacagtctactgggtgctaggggaagaggcaggcccaggaccaggtggtctttccttagtgccttcctttcacacttgcagagggccccaaatgcatgattgccaactgggtctatacagagataatgacgggaccgaaagcagacggcactcaacatgcagctttgagggcatgccttcattttcatatgtactagagcagttgcgagctggtagatactcaacactcacctctccagggaaaaatgtgtgatgtatgtgtgtgtgtacatgtatatatatgtatatatacacacatatatgtgtatatatatgtatatgtgttacgtacatatatatacacatatacacatgcttattttaaatattgaaataaaagatacactgcacacaattttacaaataaagatacaatactctcaatttaaatgcagtctacccgagtgattcttaccaaaggctttctttgatttttgccaaactcagtagccaacctatagttgcaaatgacaaatgagggtagctccaaagagaacggtgctccatattttctgtaaagagtaggatgatcgtgaaacaaatgaaacaacaaagatttatgtcccaaccttactcctttattttttaaaatttatttttattttatttatttattcatttattgagatggagtcttgctctgttgcccaggctggagtgcagcggcgcaatctcggctcactgcaacctccgcctcctgggttcaagcgattctcttgcctcagcctcccgagtagctgggactacaggcgcccaccaccacgcccggctaatttttgtatttttagtagagacggggtttcaccatgttggcgaggctgatctcaaactcctggccttgtgatccacctgcctcagcctcccaaagggctgggattacaggtgtgagccactgcgcccggcctccttctttaaatgacaggaatgatgttactcaaataagataatattgttctaatactagaatatttccttcaatttttgtgctatttattcatgctataacagctaacactgttaggtttaatctgcattattagcattttcccatcactttcttaagcctgaccacaaaaaataaattcagcccttctgtgtaatatttgctgatgacagtggtgtaaatactcccaccatagccttttctgttaccaagatgaggttgctcaatgtgatttaggagagatacccagtagcacatcattgtatagtgtgtccaccatgcagatatgtacatagaggccagtgactgccagggcatgggcaacagtcaaatgtagtaaaacaaataggaggtagtgtgttttgagtatttattacctttgtttttaatttatttaattgtaagcttatataatttagtttatatcaatggctgtttgacagccggctcacaaactccccgggctggtgggagccatctccagcacctcacttagcctcagagaagccccctgcctccttccgtgctcagccacagctcaccctgctgtctcctaatggggaaggttgactttaggtcaccagctgccttggtgacttgcctacaagtgcgagtgagtctcagtgtgtgagcttttccttgacatgatttctttagttgctaaacataccataaagcctggtttaaaggcatcttgggcctcagtgaggaacagaacggcatcttctgagacaagggttacctctgagtccctgaaggcacactggcacctggccgccaccttgaagatgaatctcatttagtcatttgactaaatgtgcctgagagtgactgagggggcttgttaaaatggagattcctggccccatacctggtgacgagcattctgagggcgggaggtgtctcccagaggtcagcacatccacccaaccaacactgcctgatgcaggcagctgcagagcccacgcccagagcagctcctcaagggcccaggcgcctgctatggggcccctgaggcaggtctggggattagcagagcccgcagctgaagtcctcttcaagggaacagaggtgtcaccagaagccaaggagggctcagccaggacttgagggtggtcactgggagggggtcttgtgctttggatccttgaccttactcatttgaggtctgccatgattgaactggacccagttgcctggaagactatgagttttccaagatcgatcatcagcaccaattaaaagacaaatagctcccatttatctcatccttgccacactgcagggtccctggcaccctctgttccccatgtgaagaaactcaaggctcagggcagctgatgactctctgaggtcatgccctggcaaatagcagaggctgggctgagcccaggactgtctgcctttagtttgctgcatgtctttgagagacagattccatctgttcatgagtcccactggcggattgtttaaactttcttatgaacattttcaaaagcccatacaaataaagagtatgtcaaccagcactttttaagatgaactgtaaccaactagcttctcacatgcttctcatatggtaagagttaattttagctcatgaaacttttggttctgtgaaacacctgctgaacagactcctgggaagggggtctgtgggagtcgacatttatacaaccttccaggtgattctgagcttatcagagctggagaggcacttgctacccaggggcttggtgtggaacgtgagatgccaaagccaaattcaggcctctcagctcaaggcaccctgaagcacagctagtcactccagcacatgttgaagctgtgcatgtttacttcatgttgaactgttcatgttttatttttggaacactggggattggcaaaaaaaaaaaaaacccatgtgaataaagccttctagggcaccactgtgccgattgtgaaccacacgtggacaaaacaagccgcgcttgatagcaactacctacatgaccagcactcccctggatgctgatgctgccatgcgagacgggacgttggcgcagcagcatgccagccacccattgcttctcctgcttgccaactcaaccgtgctgctccctcagacaccatcacttgcgcctcccaagcaatggaagccctggcgatgctctcatgagcccctcactccagcagagcccctgaccaagccaggggagcaggacttttccagccaaggcaagaaccagggttttctgactccttgaagatctggtgtttcatggagttgaactagatgctgttccaacatctgagtgcgggaaggggaggggagggtcaccaaggatcttcatggcatggggacgggcagcggggagcacattcctcaaggactgtctgtctgcccgcccgctgaccagtgatgttttccttccctgtcccgttttgttgcaggacacaacggactggtggctgtgagtacctccccacttgatcccacttcactggccctgggcgtgtggctctcagcagcctgggaaggagtgtgaagaagcaggtgggataagggccttgagagagaaggaaaaggcagcctagtcgatgctctctgctctccagtgctgactgggggctgggtcgaatgctcatctgcagccagctgtggacatcacaggctcctttcctccccttcccctaatggggaaaggtggtttccccatggcctgtgagggagtcagggagcttccagaaacaagctgacaaggtggggaagcatgtaaccaacacagcatgagagcaggtgggaaccaggggattgggcacctggggcggggtgggggcccttgactccagatcataggcagcccttgtgtctagagccctgtgttcccagccaggtccaggccaggtaccaccttggagtacatagctgctatgtggccaaagtgtgccctggagacattgaggagctcagtctagcagaagggcctgtgccctgtccccaacacaactgacttcaagatcccaaactgagctggatatcccagagctatccttagcttatgcttctgtaacctgagtccagatacctccaggaggccacagaaggcattcaaggccacaaaacaaatgtggaacatcttcttgaagcagcagcagctctagaacatcaatatagggggaaactgtggctgtgctaacggactgatgttaaaccttaatactttgcctgatgtctaagttttacttgaacattttacgtgcggcattttgtaactcaatggatcagtaatttaaaacatttattttattttattttattttaattttttttgagacggagttttgctcttgtcacccaggctggagtgcaatggcatgatctcggctcgctgcaacctctacttcccgggttcaagcaattctcctgcctcaatctcctgagtagctgggattgcaggcagccgccatcatgcctggctaacttttgtatttttagtagagacggggtttcgccatgttggccaggctgatctcgaactcctgatctcaggtgacccgcctgcctcagcctctgaaagtgctgagattacaggcgtgaaccaccacgcccggcctgattttatattaatataaacaaagattcatctcccagctctgccactttgtgaaggttaaggtgtcacttagcctctccgagtcacggtaaaatggaacaatggcacctgccctcacagagctgctgtgaaggtaatagatcatttgctgctaggacctggcacatgcagccttgcccaaatggtggctgttattactggaagtttccaggccaaggaaggctggcatccacagcccttcacccaaagcccaccaggaacacacttgtagttagtctagtttggtttcttgctctttgcagcgagggaactcacatcaggggaacctcgggttgcctcagtaggaaggtgttagaaagaacctagcacaggatttgagctttggtgatttgagggaaggcctacgaaaataggggttgccacagattagatactgtcaggaaggagggacagccctgcaactgggcagctcaagaaatctgatctgtagggaggagagacgagtgtgcagagagcagtaattgataaagaagtagcagtcactcatttcagccaagaggggtgttcggtattttctggatggcacagagacattgcttttgtttgtgcttgcctcattttatcatagtctcatagaaaccttatttgaggttgtcaatctgtgagatcgttcctgtgtaataggagaatgacgcagctcaccttgcgtgccaggcctcagccactgagtgacagctgctgtttctttctcagtaggttatgataggaggttatgttaggaggatagatgctggtttcacgctgtctggtttcaattcccaacacctctactcatcagctctgtgagcctgaggcaagctgttaacctcattgggcctcagtcttctcatctgtaaaatgggagaatcatagtacctacctcttggctggtgggaaaaattaaacaagacaatgtactcactgcttctggcacataatagctgccaagtgagctttttgaaaagtccgacttttgcatggcaccattcctgtggtcacagggccagcattttagatcggtagattcatgaccagtttggttcaacaaatatttattgatttttccactaagtgctagaaaaaaattaatagaaatccttgcatcatttgttctcccaaaataaagctctgctatgaaccgcttcatttactgagtacattctctgtgccagggaccacttaaaccctgtctaggaaccagctcagttaatcttcacagcagccttatgaagtgggtaaagccgggactactttcatcagccccacttttgcatgtgaacaaactgaggccagacggatcaggtactgaggctgcagcagcagagagagaacgagggactgaacctgggtggaagggtcagcattcacaagttccacctcactgtgctgcgcttgtaggagaaatgaggctggctccctgcctggaggagagcgacatcccagggcagggtggcaggaagcagcgtgagtccccgaggcaccaggcctctaaggagggaagaccactttcagttgggaagtggaggggcgggagcaggcctgtcggatcttagaggacatctagaaaaggcgagggtggaaagggaagcacagggaagggcattcccagaggcaggaacagcatgagcggggcagggaggccatggggtgtgggccatactggcctatagtgaggaccttagtctgcgggtcagcccgagggagccctgacatttcagagggataaagggagggccctgtgtgctgccccacttcccaggcagcgtacctgcagagactgggggtgaacaccgccgtcttcgagaggcgccatgtgatcgggggtgcagctgtcactgaggagatcatcccaggtgagctctgatgtggcatgggggagtggagggcagtgactcagggtgacagtctccatccctgctgaccccgggtgacggtctccatccctgctgaccccgggtgacggtctccatccctgctgacccctggtgacggtctccatccctgctgacccctggtgacggtcctcatccctggtgacccctggtgacagtcttcatcggattcggtttcagggtttaagttctcccgcgcgtcctacctgctcagcctgctgaggccgcagatttacactgatctggagctgaaggtagggcccccccgccggcccgattgcacggagggaggaggcagttccatcttcccaacctgtgtggggggtccctgttctgtgcccgaggtgatgcccgcccctgagggctccctcttccacccaagtcttgtgtatcccacgtggtctccctgctgcattcccacagatgggttttgtctcgtccatgtagtgtcttgaaaagtgggaaatttcatccaaaaatcagacttcttttgaagaatgagctttttcaccctcaggcccacgtgggacacctatctgaagccttgggcgcctgagcttacagctgccttgggacatgagcccgatttctgccctcattgaacttgagagctgcttccctctcttggcagctggagcaggaagtggggcctggggacttttctggctcccgggctttttggaaggttcctgggagtctcatctggcgctgtttgcctctcttagtctgctgacctttgtccacaacctggcccaaccctgccccccaccctttcaccttccttcacccccactgtcttataaaccgcgtcaccacattcttgaggctgattggcttctacctgcttagtgccactgtcactcaccactcagagaaaagggttcttggtgctatctgcagctgccactcacgttggtgccatctttttttttttttttttttttgggacggagtctggctctgtcgcccaggctggagtacggtggcgcgatctcagctcactgcaagctcctcctcccgggttcatgccattctcctgcctcagcctcctgagtagctgggactataggcgctaccaccacgccaggcaaattttttgtgtttttagtagagaagggctttcaccgtgttagccgggatggtcttgatctcctgatctcgtgatccacctgcctcagcctctcaaagtgctgggattaacaggcgtgagccaccgcacccggccacgttggtgccatctttgctctaaattcaaaattttaaactagtaagatgtccagctgttgttcacagctctttggctgctctaactggttcatgtagagagttcttcaagccactgaaacagagtatgtgcatcctggtaccaggactggatgaaatctagccaggcctggggatgggtcgctggtctccagtccagagcagaccatagcagcaggcagtttataaatgcaccacttattcatagtggcagatgttggggagcagggaccctccttttggcaaacctgatttaagagactaagaatcacagaatggacattttcacttgattattctctttctttaaaaaacgttacttatttgaaatggtatttgtcatagtgttccttgaactagaagctcccaagtgaactgagtagatgctttaacctctgccttgggctgcagtaataggagtatggagctcagagcagggagaaagcagtcctgttgtgtgatacgcaggactcaccccatctggagcaccttgttttaacaggacattgacagcctggagggcattgacaggaggacaactaaactccttccaggaatattgtctttccaaaactataatggagagcgtttattttaccagcatcacatcttgggctatgaccttaatgttctatctcaattgatccttacctgtaagtcaagagccatgttataatcagggaactaaagttcaggggttaaattcacacagctagaaagtgatggagaattcaagccaaggcctgactgtctcctactccttgttcttgagctatgatgc

SEQ ID NO: 282 - DNA, 10000 bp, Homo sapien
ggacccaatatacattatagacatttttatttaacagtggcaaaagataccatttttcttattagcctgtggaagattttctaatacagaccgtatgttaggccacaaaacaagtctcagtacattttgaaaaagcagtatactttattttcatataccacaatggataaaactaaaaatcaatattaagaggaactttggaaattgtaagaatacatggaaattaaacaacatgctcctgagcaaccactggttcaatgaagaaatttagaagaaaattaaaatgtttttgaaatatgacaatgtaaacacaacatacagcacaaatagtgctaagaggggagatgctctgaataaattctttcatccaaaagtagagagatttcaattaaacaacccagtgatccacctgagggaactagaaaactaaaaacaaactgaaccccaaattagtgaaaggaaaaatatagtaaaaataagagcagaaccaaacaactagaaactaaaaaaaaacaaacccaaactcaatgtaatgaaaagttggtttattgaaacaataaataaaattcctaagtgtctagctaggctatactatatatgtgtgtgtatatatatatatacacacacacacacgtatatatatatatgctatactatatatatagtatagatattgtgtatctatacatatataaaaatatatatatagacagaaaaaactgaatgaaacaaaatcagaaactaaaaagaagatattacaacttatatcatagaaatacaactgtatattttggacaataatacactaatgaaaccgtatgttttgaacaagtatacactataattgaacaccatggaaaaagattaattccctgacatatacaactcacacaaaatgagccaggaaagaagggtaaacctgaacagactaataatgagtaaagaaatagaatcagtaataaaaacgaaatctcccaacaaagcaaagtccaggcctagatggtttcactgatgaattctaccaaacttataaggaaaaaggaaaagcattcctcatcaaacaattccaacaaattcagagaagagaatacttcctaactaattttacaatgccaggaataccccaatgctaaaaacatacacgaacacaacaacaataactataacaaaaattagaggtcagtatttctgatgaacacagacacaaaaatcctcaagaaaatgttagcaaaccaaatctaagaacacatcagaaagataattagcaataatcaagtggtatttatcccagggatgcaagaatggttcagcatacatgaatcgataaatgtggtacatcacattaacagaataaagacaaaaccaaataagcatatgaatagatgtaggaaaaagcatttgataaaagttagcatccatttatgataaaagttcccaacgaactacacaaagaaggaatatacctctatataatgtaaccacatgtgacgaactcacacctaacatacagaatggggaaaactgaaagccatttctctaaaaactgaaataagacaccactcagtcaacattttactttatgtcatgtcctagcgagaagaatcaggcaagcaaaaaaaataaaagccatccaaattggaaaagaggaagttaaattgttcctgtttgcagacgacatagtcttatattaggaaaaacacactggggcctttcagagggtagagggtggaaggagaaagaggatcaagaaaaataactaatggtactaggcttgatacctgggtgatgaaataatctgtacgacaaacccccatgacacaagtttacctatgtgacaaacatacagttgtacgtctgaacttagaataaaagttaaaaaaattgttaacataaaaaaagaaaaatctaaactccaccaaaaaaatttaggactattcaataacattgcaggataaaatatcaatatgcaaaaattagtagcatttctatatactagcaataacccagcaggaatgaaaaatcagctatgaaattccctttacaaagctataaaaaattaattactcagtaatacatttaagcaagcagactgatgtttaccagctatatgactgaaaatgtcaggcaatcatattgagcttttgttttttcatctgaagagtaaacataatgcaaggaattattaaagggctaccataggaataaaagagctaatggtataaaacattattagtattattagtattgcatagtatctatgcaatagtgtaagtcagaaactgaaatggcagaaatctacttttaataaccatttacatttaatgtaattattggtatttttgagccatttttgtttttcatatttatactacttttgattgtttttctttttcctgatctatggattccttgaaaatgttttttgattccattttagttgatctgtaaattttttgcgtgactctctgtacagcattgttagtggttgctctgtgttacattacgcatacataccttttcacagcctagtgctgtgcacattttaccctattcagtaaaatatggaaaccttgctttcctgtctttttaactgctccccctttcccactgtttgtaacagaatcatattaaatatatgtctatgtgcatttagtgccacagtaaattttgtcatttttgctttgacataaatttattgtcttccaggtttgcagctcagaaatctgaactgggtctcactgcgttaaatccatgtctcaaggctgagttccttcctggagtctctagaagaaaagctcattatcttgccacattccttggccctcttccatctttaaagctagcaatggccagttgagccatttgaaactcatgcagaaaacgtgagaagaaagatattttgtgtttacctactttgtatttccaatttttgtttttggcttgttgtcattgttgttgttgttgctcattcttgttgttgttgctcattcttgatgttccagaaaaatcctattctattttttcctttatgattagtgaccttcatagaaccattttataagataggtctgttggaaagaaattctcttagatttttttttctgtcttctaagaatgcctgtattttctctttattgatgagtagttatattggacataaacatctggttgacattttttttctttcagcactttgaatattttagctacatcctattggttattctgctctctggtaataacaccactgttactcacattgtgttttccctatagctatggtgtcatttgtttcttgctgctttcaaaacatttcttttagtttttagaaatttgactacagtgttgcttgcatggattttcttgggtatattctggttggcagttgctcatcttcttgcatctgtaggtttatgcccattgcaagtttggagaattttcagccattatgtctttgagttctctctcaatagcatcctcattgttcttcccttctgaagctcagattttatcattatcacattatttgttataacctttcttgttcataacagtatttaaaattttaccctgtgttcgagtatacagtttctattaatccagcctcaagaatactgactctttcctccatcatttcctttctgttagtgatcacaccaaataatattttatttaattttttacactacatatctcagtatcaaaatttctatgtcattatattatatagtttcttttttctgctgggaattttttttccatttaaattgagagtgtacacattgacctcataatggatgtttgtaacacctgcttcagtgagattgaaaatctcaccgttttaatatccagattgtttcaaggttatcatctcttgattatttaactccttgagaattggtcgattgtttctgattttataaagtatgttgagtaattttctattttatcccacacacaggactttctctgtttacagtacacaataagttcaatgaaggaagttttggacattggagggtagaggccttcttgcttaattgagatccactcactggttcagatagcaggggattttgtcccactaacatttttctacttggagcttctgcctggatgatcctttatggctcttacgagataaaactataagtatatttaacatcatagcatacatagtgtgcactgaaggggtcccaaaaaattcctattcacaaagtcttttttagttttcttttgtgcatcatttgctcaaatctcaattgaatttgaggacttcattttcctttcttccctacagtaacaacacagtttaacacctgcttaattagagtctattacagtacccgggtaggcctgctgtcttctgactggggatttatagaaagtggataatacggctgaggtaaaatcaacgactacaggcctggcgaaatggctcatgcctgtaatccaactactttcaagggcagaagtgggagaattccttgacacaaggaatttgagatatgcttgggcaacatagtaagacccagtctttataaaaaaattacaaaaggatcctggctcggtggtttgcacctgtagactcagctatttgggagggtgagctgggagtatagattgagcctgggagagcaaggctactgtgagccatgattacgccactgcactccagcctaagagagagagcaagtcaaagtctgaaaaaacaacaatgaaaaccacccaaaaaacaaaaaagactagggccaccaaaaaggctttctttttcacttgacttcttgctccagggtttacctttttaaagtgcacctcccagtgtctagggagtctacagacttggagtctcttcctttcttgcctcggtatcacaagtggctccatcctatatccttcagcactccttccccatttcccacagagccaagtagaatagtgatttgaacacatataagcaattttaatccctaccctccttgatgctttacaaaattttgggatggatctgttaagcttttgtctcatttgagtcagggatatctcaggcccagctcaaatccttaaaggaactgagatcagagtagaggaatagaagtgataagggagatatgtataaagtgtcttcatgcaagtaaacaagacacatttaatttcaaattcaagcagtgcagacattgctcaaaaccaattgaataaacatttgaattttaggtctccccaaaggtctacaacagtgatggagtatctttaattcttctacctcttgttctctatggaaaaaagcaaatgtaaaggtgtcatttggtaagtttgtttcaattctaccatcagatactcagttttcaaccatttccctatcctactcattaatgaacagcataagggaaattttcatacattttggtcaacataccagctattggtgtgtcctttttacattaactgaagaataataaatagtctttacagatgttacgagattacaaaacaaaaagcatccaaaggatctaaattagggtgtaatgtggatgcctaatggttttctatcagaactctcaccaattgccctgtctgatgagagaaatgagcaggagctctgtcgtggtgaaggactctgctgaagctcccccaggcatttctctactagagttctggctttctcaaaatattctcagaataagcatatattgtccttctctggcccttcagaaagtcaataagcaaaatgccttgagcttcccaataaactcttacaattacctttgcactttcctcatccactcttctttgactggaccacttccacctcttggtagccattgctttgattgtgctttgtttcatgattgtactgataaagccatgttatatctgctgtcacaattctttgatgaaatgcttcaggatctttatccccttatttaaattttcagggaagcttcttctcttgtctgtagctgctctggttgccatagttttggcatccacagagtgaaaaatttgctcaacattaatttttcagttagaatcatgtaagatgaaccaattaaaaaacatgaagggttggctattgtttgtactcttaatcttcattcctcttctatcatggtatcaacaagatacatttgatatgaatactctgtcactgtagacttgaggttcagcaccatttcatcccttcttgaaataacatatctacttgtgaactgctgatttcttcagccattatccacatgaacttttcagaaagcatcagtggtttcaccttctttcatgcaagcttaaccataaattttctctttgttttcactttaattttagaaaaatgtattttgctcttataggggatgttttgaaactcctgtcttatttttcattattccttgaaatagctcctattcagacatcttacagcatatcagtttaggttcattttgatgccaaaaaatgtggaatccttttatggtatttcttaatataacatacattttcatgaactttttaaagacctactacattacaggaaggcctttcaataatataagaattgctacaggtaacattgaattttctagttgattaggcagattaaatttctgtttttctgctgacataaatagtgatgtgggttgagaaggaatataataccagtggtcaaatattctgcagctatgtggaaagtcaaacagttgcaactaagtgtcacatgctttaagggagtcatagagtagctgcttgggcctagcaggtaccctgatgttaacaggatgattgtctctggtttcaccaaacattacttcaaaagagttactggacatgagcagttttgcctaggtagcttacagtagaccttcaagtaggtaaggaaggtcagagagaatgagcagaggtgaatgccagtcagatgtgcctctttgagtgggtagctgaggaagttccagtcctggtgggaggcaggcttctccttgtctcctgagtccaggaagagaacaggtgatgcttccatatatcactcaactcacaccctattcctgaccctctctaatgtcagaaatgagtgagagagatttgtgtttcaggcaagaataaatattgggtatcaacctaccagacaaccaaaacagagattaccaaagagctgaaggagacactgtgactgacttagaatggagtcaaagccaggagcaggactgcagcaggcgcttaggcatctgtacaggagtcaaggacctcagcaatccacctgtcatttaaaatgaatgtaaacataccgtgtaccaagtagaatcttgatttccaccttctataacctgttctctttaatatcaacaatcattaatttcagaccaagaaaccagaatatattgagaaacacatcaatgaaacaatacatttcccagaactaaaggttaattctccatatcgaaagggcccaatgattatccaaaagcccaaatttaacattttcagggctgagtgcaagaagacaattagtggctaacatactccaactcttaataatcacacattataaagcaagctagactctaggtttagatcacatttccatgtaagtccttcagcctgttgcttggagattgctcatataagctggcatagagactaaaggtgtctgtgtttccctgtaacaatcctgaccccgcaatctgagaggtgggaggaggggggcacagggctgtctgctagagaagcacactagacgttgggctggagcccaggactgatctgcccaagcttcgagagcccctgccaggcatgttatgctcccctatgcctcacttctgagtttggactagtggcaatgtctacacagctcccaatgataaccctactgagcataggactggcagagaataataaccagaatatacaaacaaacaactcaaaaacaacaaaatagtccattaaaaagtgaacaagagatagaaatggacatcttttcaaataagacatacaaataatcaacagtatgtgaaaaatactctatatcactaatcatcagagaaataaaaatcaaaaccacactatcaccttaccctattcagaatggctatgattaaaacaaacaaacaaacaaaacagatgttgggatggatgtggagaaaggagagctcttatacaccctgattggaaagtaaatagtataaactctatggaaaacagtatgatttctcaaagaactaaaactcgattactattcaatctagcaatcttactactgtatctatgcagaggaaatgaaatcagtatatgaaaaataaatctgcacttctatgtttattgaaacaccatacacaacagcaaagatatggcatcaacctaagtaaccatcaatggatactaatgggtttgtaggtaaagaaatcgtgatatatacacaatgcaatactactctgcaaaaaaaaaaaaaaaaaaaaagaaggaacgaaatcactccttttgtagcaatacgaatggaactggatgtgacagataatatgctatgtgacaaaggccagatacagaaagtcaagtataacatgttgtcactaataagtaggtgctaaaatgtgtttacatagatatagaggggagaactatagacactgaagccttggaagagtgagtgggtgggagggaattaagagttagacattaattagtaaatgcaatgtttgttattcttgttatggaaaccctaaggccatgatttaaccattatgcaatgtatacatgtaacaaaattatctttgaaccacatatatttataaaaataaagtttaaaaataaattgagggtgaccgggtgcggtggctcacgcctgtaatcacagcactttgggatgccgaggcggatggaacacgaggtcaggagttcgataccagcctgaccaacatggtgaaaccccgtcttaactaaaaatacaaaaattagccaggcatggtggtgcatgcttgtaatcccagctactcaggaggctgaggcaggagaatcgcttgaacctgggaggcggaggttgcagtgagccgatatcttgccactgcagaccagcctgggtgacagaatgagactccatctcaaaataaataaataaataaataaataaataaataaataaataaataaatataattgaaggcaactttaaacatattttttcaaaaaagaaaaagagggagatggagtaggagaaataaaaaagaaggaagaggaggaggaggaggaagaaagagcctgcatttctaattgtcataattaaatttccataagcagatactattttttttaaaaaaaacctaattagaattttacgggtctgataagaaagaaaatgctaaaaaaaaatatggatactcaatgtgttcctattttgtttgaaagcctagaaaaaaacaatatcagagactattctacttagattttttggacaaagaaatcttaagatttttaactcgggagcatttaattcctcacaatttcatgtctgctgttctttcctaaaatcattattgtgaagcagacatgactatatccactagtttttcatgtatgtgatctgcttagtcttcatcctttaggggagccattttgattattcaaaaatttagaagaggaaacttaggctctgagacttaagtagcttcctatgagtccagagttagcaagacatagttcttaaactgcaatctgagagattccaaattctttgcccattcaagtcaggctgcctctgatgaaatccatttaggttttcttaagaatagtaagactcataggcagggacagaactgatcagtgataaaatatgggaaaataggtctagtggcttctggggaatagaggcatagaaccatactcatttccctagaaaacaaaatcggttacttttgaacttgttaaaatttctctcagcttctgggattttctttcattggtattgttttgcttacattcataagctgactagaatatcaagaaatgacctgaaaataattgt

SEQ ID NO: 283 - DNA, 6725 bp, Homo sapien
tacatataaaaaaggctgacattttatttccaggttggcacgtgtataaggcacaggggcaaatggctttggggtcctggaactggaaatggagacaggtgtgtctcaggtgtccctgcctccaccaccccctaagtgcacttgagacaggaccagtggtggtggttccagcccagggtcctgaagggtcccactggctctaggggagagccatggggacagctccccaggcgggaccctctactctccagctacccaggagggaccctctcctcctagggggcgaggccagctccaaagtgcttggtggctccccaggcttaagggaccagcctgccagggagggctggggtcagagagagaatagtaagatgagaacgaggagaagcacccccactagcacggcgatggcacaccactgtcggcggtctgggaacgagaaggtcaggggtcacggggagagggtaccacctacaacctgcccccaccaggactgacccctcccctgaggggactcaccactcgtcatgtgggatactttggccaacttcctgaggaccccgtccatgcgggactgggtgtggtccatctcttgggcgaaggcatccagcatgctgccaagaacaggatggcatcagccccagatggcccagacacaccagggcggccgagagcccctggcccacccccagggtcctggcctcacatgccctgctcgtccagctcttctccaacgcggccggacatgtgcttcagaacctggatgctcccagacaccatctccagctgttgatcctgttcatccatgatcagctgcagagcgaaggggtgggagatgctgttgaaaacgaccccagaaggccaggcgctatggcttatgactgtaatcccagcactctgggaggccgagacaggcggatcacttgaggccaggagttcgagaccagcctggccaacatggtgaaaccccatctctactaaaaatataaaaattggccaggcattgtggtgggcgcctgtaatcccagctactagggaggctgaggcaggagaatcactggaacctgggaggcggaggttgcagtgagctgagatcgcgccactgcactccagcctgggcgacaaagcgaaactccatatcaacaacaacaacaacaaaaagggaccccagacctcagatcagtctgcaaggctctcccctcccaagatccaccccgctggccccaaaacctgctgtgtggcctgctgctcctcgatgtagcgagatgtggccgagactgcgctggcatccagcaggtcgctgggtgacttctgggcagctggcttgcctgcgagtatctgcaggggcacacaacataggctcagggagagaccccaactcacagcggggcctgtggggcaaatccccacggtggtaagtcaggggggcagactctggggcaggacagcctgcattccccactcaccacttactagcaaggtgacccagagaccccatcatttggcttccttgtgcctcagtttcctcatctgtaaaatgcagagagcaggatggggcatggtagctcatgcttgtaatcccagcactctgggaggtggaggtgggcagataacttgaggtcaggagctcgagaccagcctggccaacatggtgaaaccccatctctactaaaaatacaaaaattgggccgggcacagtggctcacacctgtaatcccagcactttgggaggccgaggtagatggatcacgaggtcaagagtttgagagcagcctggccaacatggtgaaatcccgtctctactaaaaatacaaaaattagccaggcttggtggcgggtgcctgtaatcccagctactagggaggctgaggcaggtcagaatcacttgaacctgggaggctgaggttgcagtgagccgagatcacaccactgcactccagcctgggtgacaggttaagaccttctctcaaaaaaaaaaaaaaaaaaaaaaattaccgggtgtggcagtgcatgcctgtaatcccagctacttgtgaggctaaggcagcagaatcgcttgaacctggggggcggtggttgcagtgagctgagatcgcaccactgcatttccagcctgggtgtcagagtgaccttgcctcaaaaaaaaaaaaaataaaataaaatgggaagagctagaatccgtgtttcctgggttgaaatgaggatttaaagaattaattgatgggggacacttacagcagtgcccaacacatagtaatgctagtaaatgtcacattttactatttgtttatttttggggggattttagctgggattacaggcacctgccaccacatccagctaatttttgtatttttactagtgatagggtttccccatgttggccaggctggtctcgaactcctgacctcaagtgatccacctgcctcagcctcccaaagtgctgggattacaggcgtgagctaccatgcctggcccaacagatgtttgtttgtttgtctgagacagagtcttgctctgtcacctaggctggagtgcagtggtgtgatctcgcctcactgcaacctccacctcccgggttcaagcaattctcctgcctcagcttcccaagtatctgagattacaggtgatcaccaccacgcctggctaatttttgtattttttgtagagacagggtttcatcatgttggccaggctggtctcgaactcctgacctcaggtgatccacttgcctgggcctcccaaagtgctgagattttaggtgtgagccaccgtgcccggctccaacagatgtattttagagtttggacttgaattcccccaaggcagcacatctggaaggcacgtgggcactgctatgggatgacaaactgggaggagcctcagtcccccaccctccccgaccccacgtacgcttatgagggagagagaaaggctggtggttctcaacatatgaaaaatatcaacagagaacaccaagagaaaaagtggactgacagaggtggttgggagaaacacagaaacacacacacacacacacacacacacacacacacggcaggcacattacagaggaaactagcagatattaggatatgaggggggaaaatgcagatacactcagaggccaagtgcacgcacccaaataggttaggtgcatgcacagatgaaaaggcgggggcggatcacctgaggtagggagtttgagaccagcctggccaacatggggaaaccctgtctctactaaaaacacaaaaattagctgggcatggtggcacactcctgttgtcccagctacccaggaggctgaggcaggagaattgcttgaacccggaaggtggaggtttcagtgagtcaagattgcaccactgcaccccagcctgggcaacatgccaagactccatctcaaaaaaaaaaaaggaagctggccgggcgcggtggctcacgcctgtaatctcagcattttgggaggctgaagctagtggatcacaaggtcaggagatcaagaccatcctggccaacatgatgaaactccgtctctactaaaaatacaaaaattggccgggcgtggtggctcacacctgtaatcccagcactttgggaggccgaggcaggtggatcacgaggtcaagagttcaagaccagcctggccaagatgttgaagccccgtctctactagaaatacaaaatttagccacgcatggtggtgggtgcctgtaatcccagctactcgggaggctgagacagaattgcttgaacccgggaggcggaggctgcagtgagccgagatcacgtcactgcactccagcctgggcgacagagcaacactccgtctcaaaaaaaaaaaaaaaaaaaaaaattagccgggtgtggtggcatgtgcctgtattacagctactcaggaggctgaggctggagaatcgttgagcccaggaggcggaggttgcagtgagccgagactgcgccactgcactccagcctggcaacagagtgagactgcatctcaaaaaaaaaaaaaaaaaaaaaaggaagttatgtgcgatggctcacgcctgtaatcccagcactttggaaggctgaggcaggcagatcagttgatgtgaggggtttgagaccagactgaccaacatgacaaaaccctactaaaaatacaaaaattaggccaggcgcagtggctcatgcctgtaattccagcactttgggaggctgaggcaggtggatcacctgaggttgggagttcaagatcagcctgaccaacatggagaaaccccgtctctactaaaaatacaaaattagccaggcatggtggcgtatgcctataatcccagctactcgggaggctgaggcaggagaattgtttgaacccaggaggcggagattgcggtgagccgagattgcaccattgcactccagcctgggcaacaagagtgaaactccatctcaaaaaaaaaaaaaaaaaaatacagaagttaccctggcatggtgacgagcacctgtaatcccagctacttgggaggctgaggcaggagaatcgcttgaacccaggaggcagaggttgcagtgagctgagatcaagccactgcactccagcctgggcaacagaacaagactctgtctcaaagaaaaaaaaaagagtaaaaggcaggcatgcgtcctggaaacaggtgcacacaggacaaatggcatggaagcagaaaggagataggtacacaggcccccagccctctcctgcaacaggaaaccagtatagacccagaggacacagtagagaggaacccacggacatatacacatagagaggttcaggtgcacacaccgagaaagtgcaggcaggtagacagcaagaagataactgcccacagagaggacgggcactgtcgcaaaagggacaggtgaacacgcacagagggatctggcttggttacccccaggggctcaggtgggcagggtgggtcaggaaggcttacctctctgttattcctctccaaaaatgctacggctgttgggctgaccatatggtccttcatttcctggaggtaaggacagcattagggaggaaagacactcaggctgggcgcggtggctcacgcctgtaatcctagcactttgagagaccaagccgggtggatcacctgaggtcaggagttcgagaccagcctgatcaacatggtgaaaccccgtctctactaaaaacacaaaacttagccgggtatcgtggcaggcacctgtagtcccagctactcaggagactgagacacaagaatcgcttgagcctgggaggcggaggttgcagtgagccgagattgcaacactgtactccagcctgggcgacagagcgaggctctgtctcaaaaaaaaaaaaaaaaagaaagaaagaaagaaagaaaaaaaaacacactcaaaccttcccccactccccgcctgcaggacctttcctgacctggactgcctctcgcatccgctccacgaacacctttctctcctgcaggtccccggctgggagcttgaacttgcctgggttggcttccactatacgtgggctgagagtcaagggtcaaggccggagccagatatcatccccgtccctaggggtccagccctacccgaaggtgggctgccaccgcaatgggctctcccatgccaccctctgccacaaagccccaggatatcgatggtctcttccaggtcctcgaggtcccactcgatgctgcgcaggccattccgcagctcattggtcgtccagtccagctcctcgcgtccgaccgccgcgctttcctgcaggagctcgcaccagcgctggtacagcccgcgggccgtgttcaccgccttctgcacctcgctgcgggcaggggcacggcgggcgcggctgggggcaggcggtcctcccgcctgcctctgcccccgactgcaaacccaaacgcatgggggactccggagacccctatatacccctgcgtgcgcctcccactctgcaccccgacggccttgcccagcccgccgggcacgctggggccggcacccgggcactggctggcttgggtacagagcaccctccgccctcccccgtcgttgtcactcaccctcggactacaaaaaaggggtcttcgagagacatgtcagtcccttcccccccaggccgaacccccctcccggcctgggttcgcgggctggttccctcccaaccgaggagaacgcgccgccacccccgcccccgtcacgccaccatcgagagccggaccgccaggggagaaagagaagcctcggaggcccgacgtgcggacacttccgccctctcctcagccatcttggttgtgggcagaggcagcttccggtgcacatgcccccgccccttagccctctcgtgccgcaccgtagggggcggtgtcggagttctgtctgggcctattcgggtccgagttcggaatttcggttcaaggcccagttcctcggattgttcctgcgcaacttcagtttcccttccaggcacgggcaatgtaaataatgatagcctccctcatctctggcggctgggtattatggctggggaaggggctcattcgattcgttgaagcttttcatggactccctgagctggcacctgggagatcgtcccatcccagggtcccgagtgtcaggtttggctagggtctgggggagaggtggtcctcccttctccctgcgggggcgcggtgaggagcgggcctgctcctccggggagttctgcc

SEQ ID NO: 284 - DNA, 10000 bp, Homo sapien
attctctgatggcagaggcactgtatttttctcccctccagggtctggcatcctcctatcacacagtagatgtgtgatttccactgttgaacacagatgctaaaagtcactttccagccctctcacactgcacatgatagcttgttccagctatctcacactggacagtaagctatctcacactgcacatgatagcttatcccagccctctcacattgcacatgacagcttattccaatacaaaggcaaatttattttaggcacccatttttacagcttctttgacaatgccaatgcaagatctgctactcctgattctggttcctgaggctgagttgttaaagatgtcaaagtcttcttcccttgcagcaggaaggatagataagaaagcacagcacttcagaagcatcatcttgggctaattaagatgaaacaagctacttgcacagctcttttattattaagcggttccttttgtaagatgagttagtctgacacttctttagaccatgctaggtatatcaaagccactgagaagtgggcccatggtatgtgtggctaagtaggtaaacaccttgggaacttaaaagtttgctattctactttgaggaaggtggagaagccacccatgttgatgacatgaaatgctgctttaatgtctggattttcctttttattttcccattgattcttcttattgttttattctgtaaacaacttcattatggaacaaaaaaccaaagttatatatttttttggttttcattgtcccaaggaatgcattcttgttctatcgtgtcttacctttgtttcttcattgtaataatcctagtgtttctcatgtactagaatgaggtacatttattaatttcttccaagtgtctgcagaatgcttagataggcctattttctgccatcaaatcagctaatatcattaggctagaccctgtaagtttaaaaagacattagaggacactccacatttcctggtacttggttttgaagtgttcaaggttaacgctgagtcatctcaatcatcaaaataaccaccaggacaaggaggcagggtgtttggtgatagcccattcctaggtgcaattaaaaatgtcattttgaaagggacacaaatatcattttcttaggaaaagtcctctgggaagattctgctactggaaaggagtcaagtgtggtcccactccatgacagttctatggctggtccccatgctgcatttatcttctcctttatatccccttagcatttggaaacttgtcctattttctctctccagcacctagaaaaatgtgctataaagcagaacataagattaggtacttgtaactgctatagaaggtcaagatagttcctctgcccctcactctccacccatctactcggttctaccatcaactgcctcctacatccaggaatctgtatagatattatttaatctttacacatctagtcaagaatgtagtatcatttttagggataaggaaatacaatttggttaagttgctgtgttgagagggttctctaggaaccaaatgccaggatagagttagatgtacaagagatctattagaagtaacatctatgaaggatgaagatgcaagcaagcaggatggggcagagacgtgaagggagaggctgagggaggaagaggagaagggaagagcgtcagactatagtgcagctctgggcaagtctccagcacaaagattgcccagaaaggactcccatgttgggcagaaatggccagacactagtgacttcactatgcccagctattgcctgggggctgcctgggaagtgtgtggcctcaatgctaatgctgtggcgggtcccaaaggcactgcagttggaggttatcaggtaactgcacttctcacagctgaatgtcaagttcttttcttgataggaaatctaggacgtgcatagtcatggtcaccagttactcaatgccctagagctgagatgggaacctaggcctaacatcaatggctttgccttcccatgtgggagggacatcagtaacatcagcaaccacttctagcttttttcagttttcttctgtgtggcctcctttatgaccaatttactctcttctcagtaaactgattattagcaattaaacctgtgttgattttataatttactgtaagcacataatgctatgagtcttttgaattttataaacctgacaagttgagggataggcagataaaaacaaagaagggattttatttgaaccagacttgtctcagttccccaactaggttctttcatatatattcatccctgcctcctgatggttaaaattagtaattattaatatctacttttacatggtactttaaggtggtggtgtgtgtggcgggggagcattccagatgatgagaatagcttggctaaacctaaggaggacagagtgagcaggggagctctggggaaacaggagaatgtgacctggttggagtgggttcgtggtggtggggggaatggaaggtaagtagggggaacattaaagctgccaaaaaagttcatacttgatggaataggtcaaatggagccagaaaacaattttaagcagtagtagatctttcttgattaaatcagcttctcaaccctgagcaaattgagatattttcttcctttgaaaagtacaatagctccaatatggaaatattccagttaaaggggcatgaggaaagagggggcaggcagacccctatctacctgcctgcctctagcctcctctctctctggaataccaaaggctctgcagagcacagttgagaaacattatcccaccagatttcctttcttcagcccgaggctggattgtaattgaggcaatgagaatgggcacaccatggtccccacagcttgtagaatcttccttgctatctccgcatcagaattccagaaaatttatcttttctatagttctattactcaaaaccaagagtcaattagaaagttcaaaggaatagttgttttgattggggagcaattggttttcagttttgcatatgtggcttttataataatgcacttcattcctgctaaataaagatacagctttttatttagctatagctaaagctattgctgttttcgtcatctgaatgcacccccactaccaccaccttaaagtaaaatataacagtagataattcactactaattttaagtatacagatatagcttcaggcagatatagcttggttgagctggaaagactgaagacccaaactgaacctaatgggtttaactcccatttcagcaaaggttgatggatcaggacaaatgactgttagtactgacagttctatttatcaatttcttggaacttgggtgagttaaacccattgttaaaatcacaactctgagatgatgtttaataaagttccctgatccttatttccccacatgagactacaccaacgtagactgctggatcctctgaatcaccttcccatacatgcctatgtattgcaggcagaggaagacaagaagaatctgagcaggatgcaaactcagatggataaacttcagctaaaagtgcaaaattacaagcagcaagtcgaggtggcggtgagtgcctggggaagtttcagcctcatggatttcccagtgttgttttgattaagggagatctgtgaccctgagctcagcaagcagcttgtcagagagggcctgctcagcttagagtctgctcatcctcagttttttttctcaagttagaattctcacccatggcaaaaatgtgcgtggcttttccctccaggaagccagagctctctcctttacctttgtggttgcacccaaacaggtacacaacaagaaatgagataggtaaaagcagagtgtcacgtagggaaggccagttttgggcaaggtagtcaccctggggcctccctcatcccaaaaccttgggtaaacataaacatggttcacagtatttgttcttgatgatcctggatatggttgtggacaaaaccaccataaattgaaatgtacttgccatccctgggtcagtatctataactacagggaatgtaattgataagtgtcatatatattgatttatccctaatattaactcttgaggggttttgattatttcaatgatttggcctaaaacactacctgttctagcccaaggtctaataattacctgttgacccatataattttaaagacaagccccctctacccaggggtagaataggatgttaaactcatgacaaaatagacaactgtggttattctagcacattttcagtctgtgagagctttactgcatccagttgatgaaaagtgccaactaggttctgaatttccaaggaacaaaagttataaaaaaatggatcttatacctgctagaaagtctgaatcctaatatatcataccaaaatatgatatcccattcaatactcagaagtttagattcttttcacattattcaactttctcatgtcagagcagaaaaaaaaaacacctgactatataggcatggagatttctttttttttttttttatttttataggaaacacaagccaatcaatacctttccaagtataagaaacagcaacatgagttgaatgaagtgaaggaaagggcagaggtggcagaatctcaagtcaataaactcaaaattaaagcaagagagtttgggaaaaaggtatggcagatattcaactctgttctaactctttaatcatgtttgtttagggctgatgtcattgcatggaccagtataacaagaaatttgtttttctccttaaaagcttttaaaagataagaacaaagggttccaataaaatcttcccatgtttgctaaattatacttgtcctggtagatgaaatgctaagcatttgagtgacatgcacattgtatttatacttttcaaatgcttacttccatgttaacttgcaggatctaagatttagggcctggattcattagtgtaaagtagtcaggagtccatggaacaaagttgattttaaaaagcacagatggatcggctcaaaattcagagtgaactctttccacagtagacacatacgtgactttgtaccatatcaatttggagtccaagagggaagatgtttaaaattgaggcagtgaaggaaaacaaataccagagtcttgctttgtagttctctgctttatattcctgattctgcccaaaaacacagagaaaggatctttctatgtctctttggtccacaaaatggctcttctaatctaatggtagaggccattgccctgattttactggtagagtgacaaagaacaatgtactaaatgtttggtagggtcaggtagtcttggcttccttgttgaaattttcccaggaacacacagtttttaaacgaggtctggctttaggcgaaaggaatcaaaggagattggataatgtggtattagctaatagattgcctgaaatcactgagcatagcttctggcatagttaggcaccatcatttcattattattattttttttttaaacgtggtgcatcaccagccctctttctctgtgttttcgggcagaatcaggaatataaagcagagaactacaaagcaagactcttgcatttgttttccttcactgcctcaatcttaaacgtcttccctcttggactccatattgacatggtaaaaagtcacacatgtgtctactatggaaagagttcactccaaattttgagccgatccatctgtgctttttaaaatcatctttgttccatggactcctgattattttatacaaatgaatccaggccctaactgaattactagtaaccctgcaaggtaagttgatagggttgccaataatatgcataaatactaccttaagggaggtcaaaagcatctcttttgaaggagagcctaagagttggttatattgaatatacttagatctaaatataagaaatatgaatcattgagagactccagaaattttttactgatgcctgaatagctgcctcaaggataagtcctatgcgagaggggcaattaagtggtttgaactttggcctcaatttgagaagtgttgtggcactggatttagggtcttctctgcagagcccaccagcaaccccatgtaatgacttgtttagggaggtgcttcccatgtgctgcaattgcattcagctgcaggaggttgaagggccttcaaaacagatgccatgcattcgactttgtcacagttattttcaacaaagaacagagtgagtgaagtagaaattgcttttgagaggccagagaggaataggaaaaccttccttggcagtgcaatgactaattgtttccccttcacagaagaaaagccaaaaaatcctcaactgtcatatgcacaaggaagaggtttgctgatagaattctgtgtcagggctggggagcaaactggtgatgtggctgcagaatctttctccttatggggttggcaaaggggggcgctgccttcattggcaagacaaggcaggcagaaaattgagagtgaccgagcatgcccttggggtgaattaccagggtctgctttctgtaatgcagataattgcctcaattccctgcctccctttgaagttaatgaagagttggctaaggcctgcttacctctggaagggactcagcttggttctggacatgtgttccactggtgaaaatcacaggaaattcacagaacacactgacattctgtttttcaggttcaagaagaatagcatcccctgctttgaaaggacaacagctggagaagtacaaggaaggtgctgtttcatggccaaaaacttaggttgcatggaaacatttttaaaaacatgtttaaattgcttttcacaccatataaacaaggcaattagaaaaataattaaagggaatatcattgcttccacagttaatggggattttttgatcctcaaatgcaagtaaactaccttctaatgcttcacatgacagattaaataaatggaagaaccttttcaattctgatgtttaaaaaatgaataaatacttgatcctttgtccatatttcctcttaatgggtaggactcatagaagatgtccttagaccagtcacgcttcatggggactagggcatgttggtgaatggtttttactaaagttaggcaactttggcttgattcacccctaaatctatgaatgtatattgtgagccagcagtggtagaatggaagtcataagatctcctcagcattgtgatataaatatagctatagttaggcaatttgaacatgtaggcaaaactctcctaatcaacacacatgtaggctatatgctggtacatgctttaaacatggaggtaaccccacacgagacattcagtgacaggtaatatgctggatttgtgcagtaccgatttggctcagctggaggaacatgtcccggaattcctctctctcatggttctggattggagtaggtcataaagaaatttgcattaatttgatcagcagctattttatactcataaggtcagtgtacagacccaagcatggtgacagcttgaaaatatgactccaggccaaaaaggggagctagaagagaccagagacagctccctggacccagagctcttccagctcctgccagcctcctccttcagctttgcaaagtactggccaggtgtgtgtgcagctccatggcaaccagcatcagcttttcctgagatcacacacagcattgcagtggaggccgtgagacagacatgggttctgtttgttcttatggacttcccttcatccttgctgcattcacagtcgacctacagtgacttcaggcccagaaccagatgcagagggaacagcctggcctagacttctccaccagcacccacaattgtgtaaggctgaagctctataataaatctttattctgtcattctctgattctgcctccctgatccaaccctgactcatatgggtagcttgacgattaattcagggactcagtggtatcagaggacccaggttcattcttgtcggaatctcttgtcgccgtaagaggacttcagcagtcctgagcattttctccccatacgataacctgtctcttcttaaaatggagaaacactttcccagaaacagacctctggaataattttcctcataccctagtgagcagatttctttatctgcttatgctgaaccagtctagtggcaagaggactgcaattgtcagggttggctcagacagatcaaagtggatgctcttgaaaaatcagggtaccattttgagcaaggtgaaccaaatttgagttttgtggttggcggagagggatgcacagccacagagtgaactagcaggtatgtgtgtcgggctgtatccaaagcagtcgctccttcttaccatcggtcttaacgcaatgagaaaacaacatgaaacatttaacatggaacttttctagggttttttttttttcctggaatagtaattttttaaaacttcagtaaaaaatgtttggaattatcctttaataagccaatgtttatattcaggaaacatctctatatcccaaaccttttcttagaaatttgctgttgtcatattaccaatcctgaagttaggatgctattgtttctccacaccccaggcacatactcagtaaagtaaaacttcagcttggggatgcatccagttttgttattaagtatcatgttctctcactaggacacaatttttaaaaaggaaccaaggctagggggaagcagagatggtagacaaatattatctcaatggagtttttcttcacaatggaatttttttaaaagatatctaagttatatttatttttttaaaaaaaatttactttaagtaagttctgggatacacgtgcagaacatgcaggtttgttacataggtatatgtgtgccatggtggtttgctgtacctattgaaccgtcctctaggttccctcccccgccccccaccctgcaacaggccctggtgtgtgttgttcccctccctgtgtccatgtgttctccttgttcagctcccacttatgagtgagaacatgtggtttggttttctgttcctgtgttagtttgctgataatgatggcttccagcttcatccatgtccatgcaaaggacatgatctcattccttttcatggctgcatagtattccatggtgtttgtatcacattttctttatccagtctaccattgatgggtattcgggttggttccatgtctttactattgtaaatagtgcaataaacatacatgtgcatgtgtctttatagtagaatgatttataatcctttgggtatatacccagtaatgggattgctggttcaaatggtatttctgtttctagatccttgaggaatcgccacacagtcttccacaatggttgaactaatttacattcccaccaagagtgtaaaggcattcctgtttctccacagccttgccagcatctattgtttgactttttaataattaacattctgactggaattcttaatactttgctatttgtgataacccatcacaacattgtagcaaaaacagagttaactacatacaaggagaggattgtgaaactgaggtcagataaaattggaccaggtggcagttacaccacaattcagaatttgctttctcttatagagttgaaaccttgatctactaagtcacacaaaagcctggttatagtgacaagttcacaagcattaacattagactgtttcttttatgtaaattgatgactaaaattaagggaaacagattaggttagctgagttctcccttctcttgcttaaaaatttatatgaaaatctaaatttattagaagattgattagcaatatgccaattgagccagaagagttgtttaaattatcttcatggctagtcactcaactatgcaagccttgtgtggtcaagtgtaacctaacttcagagattcttatgttcatagttccatgtgcatccatgtgaagagaccaccaaacagg

SEQ ID NO: 285 - DNA, 10000 bp, Homo sapien
cacaaaaaaacaaaaaacaaaacaacaacaaaaaactaaggcaccagggaccaatcctggagaaacagagatatgtgacctttcagacagagaattcaaaatagctgttttgaggaaactcaatgaaattcaagatgacacagagaatatttcagaattctactcaataaatttaacaaagattgaaataattaaaaagaatcaagcagaaattcagtttaaaaatgcaactgacatactgaagaatgactgaagaatgcatcagagtctcttttttttttttttgagacggagtctcgctctgttgcccaggccggactgtggactgcagtggcacaatctcggctcactgcaagctccgcttcccgggttcacgcgagtagtgatcatgcaaaagaaagaattgatgagcttaaagacaggccatttgaaaatacagtcagaggagacaaaagaaaacaatgaagcatgcctgcaagatagcctcaaaaaagcaaatctaggagttattggccttaaagaggaggcagagacagagatagatgtagaaagtttgttcaaagggataatattagagaatgtcccaaacctagagaatgatatcaatattaaagtacaagaaggttatagaacaccaagcatatttaactcaaaaaggttaccttaagtcatttaataaactcccaaaagttaaggataaagaaaggatcctaaggcagcaagagaaaagaaataagtaacatacaatcaaactacaatatatctggcagcagacttttcagtgcaaacattacaggccaggaaagagggacatgacatatctaaagtgctgaaggaaaaagacttttaccctagaatagtatacccagtaaaaatatctctcaagcatgaagaagcaataagtactttcccagagaaacaaaagctgagacctgtcctataagaaatgctaaacaccagacctgtcctacaagaaatgcaaatcagagttcttcaatctgaaagaaacaggcattaatgaccaataagaaatcatccgaaggtacaaaactcactgataatagtaagcacacagaaaaacacagaatattataacactgtaattgtggtatgtaaactactcaagtaaaaagactaaatgatgaaccaataaaaaataataactacaacaacttttcaggacatagtcaatacaataagatataaagagaaataataaaaaagtaaaacatagggggacaaagtgtagagtttttgttagttttctcttggttgtttgtctgtttatgcaatcagtgttaagttgtcatcagtttaaaataatgggttataagatattcttttcaagcctcatggcaacctcaaatctaaaaacatgatgaatacacaaaaaaataaaaagcaagaaacatatcaccggagaaaatcaccttcactaaaaggaaatataggaaggaaaaaaggaaaagaaaagaaaaccatgaaacaatcagaaaacaacaaaatggcaggagtaagtccctatcaataataacattgaatgtaagtggactaaactctccaatcaaaagacatagagtggctcaatggatttgaaaaaaaaaaaaaaaagacccaatgatctgttggttacaagcaacatgcttcacctatgaagatatacacagactgaaaatattgggatggaaaaagatatcccatgccaatgggaatttttaaaaaaagagcaggagtagctatacttatatcaggtagcagattttaaggcaaaaactgtaagaaaggacaaagaaggtcattatgtaataataaaggggtcagttcagcaagaggacataacaattgtaaatatatatgcacccaatactggagcacccagatatataaagctaatattataagagctaaagagagagatagacttcaatacaataatagcttgaaacttcaacactcctttcaacattggacaggtcttccagacagaaaatcaacaaagaaacattggacttaatctggactatggaacaaatggacctaatagatatttacagaacacttcatctaaaggctgcagagtacacattcttctcctcagcacatgaataattctcaaggatagaccatatgttaggttacaaagcaagtcttaaaacatttaaaaaattaaaataatatcaaataatatctgaccacaatgaaataaaatagaaataagtaacaagagaaaatttagaaactatacaaacacatgaaaattaaacaatatgctcctgactgatgagtgggtcaattaaaaaatttagaaggaaattaaaatgtttcttgaaacaaatgaaaatggaaacacaacataccaaaacctatgagatacagcaaaatcagtactaagtgggaaatttatacctgtaaatgcctacctcaaaaaagaaaagaaaaaaaaaaacttcaagtaaataatctaatgctgcatcttaaagaactagaaaagcaagagcaaaccaaacccaaaattagtagtaaaaaataagaaagatcagagcagaaataaatgaaattgaagaagttaatacaaatgatcaaagggaaaagtcggttctttgaaaagataaacaaaactgacaaacctttagccagactaaagaaaatgagagagaagacccaaataaataaaatcgaagatgaaaaaagagacattacaactgatactacagaaattcaaaggattattagtggctacgatgagcaattatatgccaacacattagaaaatctagaggaaatggataaattcctagacacatataacctcccaagattaaacaatgaagaaatccaaaacgtgaacacactaagtaacagatcaaagctgtaataaaaagctcccaataaagaaaagcccaggacttgatggcttcattgctgaattctaccaaacatttaaaaaactaacaccaaccctactcaaactatttcaaaaaatagaggacgagggaatacttccatattcattcaacaaggccagtattaccctgataccaaaaccagagaaagacatatcaataaaaggaagaagaaaactacagccaatatccctgatgaatacttatgcaaaaatcctcaacataatactagcaaaccgaatgcaacaatacattaaaaggatcattcatcatgatcaagtgagatttatcccagggatgcaagcatggctcaacatacacaaatcaatcaatgataacgcatcatatcaacagaatgaaggtcaaaagccatgatcatttcaattaatgttgaaaaaatattcgatgaaattcaacatcatttcatgatttaaaaaaaaacctttaagaacctgggtatagaataaacatattaatatcttgacataataaaagccatatatgacaaacccacagttagtcttatactgaatggagaaaaactgaaagcctttcctctaagatctggaacaagacaaggatgcccactttcatcactgttattcaacatagtactggaagtcctacctagagcaatcagacaacagaaagaactaaagggcaaattggaaaggaagaagtcaaatcatccttgtttgcaaatgatataatcttatatttggaaaaacctaaaaatactaccaagaaactattagacctgataaacaaatttgtaaggttgcaggacacaaaatcaacatgcaaaagtcagtgagtagcatttctatttgccaatagtaaacaacgtggaaaagaaatcaagaaagtaatcccatttacaactgccacaaatcgaattaaatacctagaaattaagcaaagtgaaagatctctacaatgacaactataaaacaccagtaaaggaaattgaagaggacaccaaaaaatggaaagatattccatgttcatggattggaagaatcaattgttaaaatgtccacactacccaaaacaatctacagattcaatgcaacccctatcgaaataccaatgacattttcagagaaataagaaaaaacaatcctaggatttatgtgaaaccataaaagacccagaatagtcacacctatcttcaaaaaaatgtacaaaactggctgggcgtggtggctcacgcctgtaatcccagcactttgggaggccgaggtgggcagatcatgaggtcaggacatcgacaccatcctggctaacacggtgaaactccgtctctactaaaaatacaaaaaattggcgggcgcctgtagtcccacctactagagaggctgaggcaggagaatggcgtgagcctgggaggcagagcttgcagtgagttgagattgtgccactgcactccagcctgggcgacagagcgagactccgtctcaaaaaaaaaaaaaaaaaaaaagtacaaaactgaaggaatcacagtatgcgacgtctaattgtactacagagctatagtaatgaaaacaacataatactggcataaaaaacagacacataaaccgatggaacagaatacagaaccccgaaacaaatccatatacctacagtgacctcattttcgatgaaggctccaagaatatacactgggaaaagaacagtcttttcaataaatggtgctgggaaaactggatatccatatgcagaagaatgaaaatagaccattatctctcaccatatataaaaatcaaatcaaaatggattaaatagttaaatctaagacctcaaactatgaaactactaccaaaaaaaaaaaaaaaaaaaaaattggggaaacgctccaggacactggtgtgggcaaagatttcttaaggaatactccacagcacaggcagccaaagcaaaaatggacaaataggatcacatcaagttaaaaagcttctgcacaacaatagacacaatcaacaaagtgaagaggcaacccataggatgggagaaaatatttgcaaactacctatttgacaagagattaataatcagaatatataaggaggtcaacaactctacaagaacaaatctaataatccaatttaaaaatgggcaaaacatctgaatagatatttctcaaaagaagatgtacaaatggcaaacagataatcagaaaatatgtaaatcaaaactacaatgagatgctatctcaccacagttaaaatggcttttctccaaaagacaggcaataataaatgctggagaggatgtggagaaaagggaaccctcatatactgttggtggcaatttaaattagtacaaccacttggaaagcagtttgcaggttcctcaaaaaattaaacattgagctaccatatgatacagcaatctcactgctgagtatataccacaaaaaaagaaatcagtatattaaagagatatctgcatttccatatttgttgcagcactgttcacaaaagccaagatttgaaagcaacctaagtgttcatcgacagatgaatgcagaaagaaaatgtggcatatacacaatggagtactgttcaactacaaaaaagaatgagatcctgtcatttgcaacaacatgggtggaactggaggtcattatgttaagtgaaataagccaggcatagaaaaacaaacattgcatgatctcacttatttgtgggggctaaaaattaaaacaattgaattcatagagatagagaatagcaggatggttaccagaggctgggaagggtaatgtggtatctggtgggggaaaaagtggggatggttaataggtacaaaaaatagagagaatgaataagacctagtatttgataacaaaacagggcaactatagtcaataactacattttaatataactaaaagagtatatttggattgtttgtaacagaaaggatagatgcttgagaggatggataacccatttaccatgatgaaattattatgcattgcatgcttaaacaaaggactatgtttagtatctcatgtaccccataaatatatgcacctattatgtatgcaaaaattaacaattaaaagtttctggcttttaaaaaacatatccaataaataaatattggtttgaatgtctgtttaggtttattttgtaatgatctgataatgttgtgaatatgttcataatttattaaaacaatctacttttcttacttgaaatatttcacctttagttgctgaggaatggctcttgtcataggccttcagacttagttttccttagattagaataatgcaaaactttacaactatttcttgtaattagcccttccttttggcacatagtattttcaagggagatgtcaaaggtccatggtgacagtttcctataccattgctattttctctgagtcgagttagtgcactgacagagattattcatactgcggaggtgtgttcttgtgatgttagaatccttattgtggttgttacatttcacggttaaaaaaaaaaagatacaatcctggagatatgctctaaacaccaacataatgtttgaaattgaaaagatgaagaatctggtctttgctcttttgaagtattaatcaaatactatcaaccttgatgtaacaatactgtaaattcagctttattctgagctagaacaatgtctccttgtgatgactattttaatcttattttgcttccatatttacccagagaaataatttagtggttttcaaatagtttcatttgtttttttttttttttttttttttaaggcaaaatggtgttgtggggagtacactgattattttattttactttaagttctgggatgcgtgtgcagaacgtgtaggtttgtttcataggtattcatgtgccatggtggtttgctacacctatcaacccgtcatctaagtttttaagccccacatgcattagggatttgtcctaatgctctccgttcccttgccctccaccctccaacaggccacagtgtgtgatgttcccctccctgtgtccttgtgttctcactgttcaactcccatttatgagtgagaaaaggcggtgtttggttttctgttcctatgttagtttgctgagaatgatggtttccagcttcatccatgtccctgcaaaggacatgaactcatttttttatggctgcatggtattccatgatgtatatgtgccacattttctttatgcagtctgccattgatgggcatttgggtttgccaagtctttgctattgtaaatagtgctgcaataaacacatggagagtacactgattttgatgtgaggagtctagaatcaccttactactcaaacattgcatgaccttgagcaaatcacttctttaatgtccttgcctctcaaatggagatatctttcctacataacttcaaaactttcagtctcctagatcattatcagtttgttcaaccttgctaggcagtattaggaattattaaagttcatgtagtttaaatggatcaagcaaatgttatgagattgtgatattttttatgcaataaacttaacactcaaacatttttggggccatgtgaaaatagaagttggactactggttatattttcctctctttgctttagtaaggatagttgaagataaaaaacctttaataactttatgatcaaggagtaagtgtaaacagattgaatgactaacggaaatttcatttgctactttgggaaagaaaactaataaatgttcatttaaaatgaaacagtcaggcaagtagcattttatccattttccagaaaagaaactggttgagaaaagtaatgtcttcatgatcatacaatatgctagatatggaattcaaaaatctaaacctagatctgagtgagaaatctgctttctactatagcagttgttttcaaaatataatgtgcatcagaacacctgtggtacttactccaaatggagattcccagacagcttattggaatatgcattgttataaatacatcatgtaatgtgatggtggtccaggataattaagaacaagagctcattagttctgttaagtagcatgttcaaatctgcactagttactgaaaactgccaactcaagaaaatcaaactatgtatctttataataaattagtattcatttgttgtttttatctgggtataaaccagaatagtacattactgtgatcctagaattcttatctacgaggctcacagataaggtattccaggagtattttataaatgcaggtggttcttgctaactttgaatctggtaaaatataagcctaccttccctgaattaatcataaaataaaatttatcataaaatttttttaaaaggaagaaaatactgtatttcttgtgtgcacgaagtcaacccaaagtgaggctgcaactatgaagagaataccagctaagggactccaatcaaatctcagaatgccactttgtacctatgactttggacaaattatttccctcttacttgagtctcaggttcatcatttgtaaaataagcataacaacattcacctcagagttattcatggatcaaatgaggtactaaacacatttgaaggtgtcccatagaagctataaaatgttacacacatggacaataaatatgaaggaaaatctaagacatatcatctaacagcagctgcagtgatattaccggatactttcaggttgtttttgatggaaatatttccactttaagagctttctggtcctcactggatttctcagcagggtggagtgttctggatcatccctcagtaggcacaggcatgacagtgatcactgtgtgtggtagaatgacccctgcaattgtctttactgttaaagtatacatcaaaaactataatcccattaccttcagcacctaaagaattaaatataacttcctggagcactgtcctactacattctccctatataccaactattgtattaagttctctggccccatccttggagctaagcatggcaagtcaacaccaataccctattacaacatgagtttgtggagaaagcatgtgatgaggcatcagagaccctcaagtactgagactggcctagccactatctggccatgtgacattgggtacaacatacctgtaaaataagaaaatgtattatatgtcactaaggacccaatgaactttggcattctgttattttaaaacaatcgtggcattttataagtctatataactgtcttcttggatattttccttcccattttcctaacgtttctcaaaacagtagaaaaagtttaagcccaattaaacagaaagatacatttgaagtaaagatttcaagtagtttcagaatatgcttataatgaaatacacagataaaatagttgttcaattaagaaacatttattcttttctaaatgaaagtgaaattgcagttgtaagtatgaactaagaaacattggttttacaagataactagctatatgaccatgaccttaaggtgtgatatggtttggctctgtgtctccacccaaatatcttgtatctcccattattccatgttgtgggaggggcctggtgggaaataatttaatcacgggggcaggtctttcccatgctgttctcgtgatagtaagcctcatgagatctgatggttttaaaaatgggagtttccctgcacaagctctctctccttgtctgctgccatccatgtaagatgtgacttgctcctctttgccttccaccatgattgtgaggcctccttagtcatgtggaactgtaagtccattaaacctctttcttttgtaaattgcccaatctcaggtatgtctttatcagcagcatgaaaatggactaatacaaggtgctagacaaggtgattaaaggctctataaattctaaattgtgcaattctaagacattcttggcattttacatgtctagatgactgccatcttttttttaatatttttccctcacatgttccagtctattctcattacagaagaatacgtttaacatacagttacagaaacagaggttttaaataaatatttaaaagtaacttcaaaatatatttgcactgaaatatggaggcaaaattgtttctgagtcagg

SEQ ID NO: 286 - DNA, 10000 bp, Homo sapien
tatttattttattcatttaaaaaatatatataagtagattatttgggtcaaggactgtaatatttgggtcaaggactgtaactcaggagcatggattcaagttgtcctaactatatgctccttattttattcttgcctatctgtagaaaagattctttttgcttgaactttgtgtcacattttattttcagatcttcattgtgtacttcattgcgggtgtgaaaaagctggatgcagactgggttgaaggctattccatggaatatttgtcccggcactggctcttcagtcccttcaagtgagtggcagtcatggtggaggcctctttgaggcatgggtacagagcaggtgactcatctctctcagtaatggcacctgttcctactttgcctgaatttgccacatgccttcctttgtccactcatttccctattcagcagaagcagagtcagtggtatcaaaagattgagccctagctgctcttgggagatatatggtatagataggcaagaaaggaaaagaaatttaaaaaggaaaggaaagagccggaactggctgacttggtgagtgagccagtgccctcagcagctgccttggatggtgcctgtgtccttgccttgccactctagcctcccatcagagccctgcagctgatgtactgagaagatgggcactcactgttcaggctctgacaaaaccattattatcacttccacaaaacaaagggtcacctttctgatttgtcttcttcccatttcttctttcctcttgttttactttattctctttcttcttccctgttattttccagttcctgaagtttgacttcattatgatgttagccaagcattcaccttttaaagtgtcctctcactcatgacctccgtggggaacgtcccttccacaacacacacacatctcagtcaaattttgtcctaggagatctgcccttgcttattacataggatatgttagaaaacattgaacacctaaagtgtgtgaaaatgtagagggggctgggcatggtggctcatgcctgtaatcccggcactttgggatgctggggtgggaggattgcttgagcccaggagttcaagaccagcctgagcaatataagacactgtctctacaaaaaaattttttaaaaaaacagctaggcgtggtggcacgtgcctgtggttccagctacttcggaggctgagacaggaggattgcttgagcccaggagtttgaggctacagtgcaccatgatcatgccattgccttccagcctaggcgacagagtgaaacttcgtttcaacaacaacaacaacaacaacaacaacaaacaacctagaggagtgtcttcatgggtggattatgtaccttaggcatctacccagccactggagtagccaaggcacattcgtgctgtgaatgtgctttgatgtgttctccagtgggctggtgcttgaactttctccatgtgtttgcagactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtcagtacctgtagcctgggaggaaacaggaaccacagttttgcaggaagggactagccagaggcattgtttgggagtgggagagggtggtgtgagcaggagctaaattgaacccagggcagtcactatgaagtaggcataaatggggataagaggactggggcttctgggctcagttagtatgttgtacagtagggaatctccaggaagaacaaatatcttacagttaagaactactttgtggccgggcttggtggctcaggtttgtaatcctagcactttgggaggccgaggtgggtggatcacctgaggtcaggagttcgagaccggcctgaccaacatggtgaaaccccgtctctactaaaaatacaaaaacttagctgagcatggtggcgcatgcctgtaattccagctacttgggaggctgaggcaagagaatcgcttgaacccaggaggcagaggttgcagtgagctgagatcacgccactgcactccagcctgggcgacagagaaagactgtctcaaaaaaaaaagaagaactactttccttttcagtggaacacctgggagaagtctcctaagggaacggggttgaagaggcccagccaaactcctgaaatatgtattttctccctgctttcctaggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccaggtttgtaggggctgtggagtgtacagcaaaggctggacttagaaaggaacggatgacaatagttgggaaagaatggggctggttttgcagccccttcttggtaggggatggggtcagtgtgagaagcattgagctgattcccctctgtgctgccttcccagggctataacaactggacaaatgggctgtatggctattcctgggacatgatggtgcactcccgctcccaccagcacgtgaagatcacctaccgtgatggccgcactggcgaactgggctaccttaaccctggggtgagatgtctgatgctgacaatttactgttcttcagagcccccttgtgctttggggtctggttttgtcttacacacaccataaagcaaaacaaatttgagtctgctttgccttttctcaagagccagattgaactatcttttatgtgggttgagatagggcaatgcattcatttccttgaactgagattagattcaggaaaagtaagcaccactagcccaacaatgaaaaattcattcccaaaggcaagttccatttttttctagccagaatgggcagcaggcagggatctcgttgtgccattggcagtgcatgacatgtcttggaagttgataatgatgaggtgggactaatatgggggtttggggcaggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggtgggcaaggggagcagagagtgggaaaaaatgaagcacagttctttttaccaagatgaacagcccttgcttcctggtattgtcttgcttaaaaagctgtccttcctctagtgcatgtcccccttgatctggttgtgggcatagctggttgcttccagcagggggcaccatcatccaggagaaaagtgagttgacttgttcttttagacactgttgacataataccttctcaggtagctactaacccccattatacccagtgctccagatctcttctgccttctttctctgccctggactggcaataacatgctgacacaggccatttcttcttctattccctgtccttaggaatgatgatgaaagggagagaactggaagttctggtgggtgggtggctgtgatgtccttagaacatggttttctttcctaaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggtatggaggaaagtgaggagaggcttttctgtctttccttctggcttccttggccagggacattccatgtggtgggaggggagagggaatgtttttgaaacctaaggggatgatggtggtaaaggtgtgatgtctctgttctggctgggagtgagttcactctgccatggggtgggatgatgaactctgttggtctggcaggactgcacttggagaattttgtgagtgaagacctgggcaacactagcatccagctgctgcagggggaagtgactgtggagcttgtggcagaacagaagaaccagactcttcgagagggagaaaaaatgcaggtattttgctgggattaacaacagcagaaagaactgagtgcagtagctcacaccagtaatcccagcttcttaggaggctgaggtgggaagccaggaattcacagtgagcctgagcaacagagtgagaccccatctctaacaatttaaaaaacaatggcagaaagcttagatgagcaagattcacttattatagactgaaaatattttaccatagcagtaatgcagtggagctcaaaaaacaagggcccctgggactgtgaagagcctcatccaggattctagaggtccgttactttcgattccaaaacacaattgagtagaaagaagccaagagtcatagagtagggaggccataagctggctagagaaaagctgatgaaatttatccatttcttctcccttgtcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtggtgagtgtatgaacatttgggctgagatagcctctggtttcaagaagtcagggttatgaatgatgttctagccattcaagaatgaacttgaagtctctagctggcagaagaggagttctaaggggagagagtgatccatctcagtgattcctcttttttctgtcttccgggcagaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcaggtaagttcacaacaatatttgtcattgccatcatatgttggcaagcttggtaactttcccctggggagagtaactctagagactgtcatacaggaaaggacagtttagctctaggtatcttttcctgccattcttcttgatttactggaagaataagtggcctatatctgatggcctgctttcttgttctgcctcagcttatctccagcctctctgtgggctgttcctaccctatcctggaatcctctaccagactgtataaagagtggtgtacccttccagctgggagatggagggtcacttggggggagattcccatatatgcctgtgtgggaggagtgaggaccaggtgccttctaagggctttagctgaaattcttctggtgaaacaggagtttgaacttggtcggctttttcctgtttttcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgcacacaaagtaatttatcttcattgcaattttggttccttctttgttcctattatctatatacacccagtgtttcactagcagttatgagagcagtcagaatagcagcatcaaagttaaataaggaaatctagatgattgctagattttctctaaaaataagcttagtatttggtattattctagcctttggtgagcagaaggggaggtaaagtaagaattaactaaatttagtaagggattagggaatgcttagacattttgtaggttggggtatacaagggtaactcaggaagctcctcagttcagtgaaaattcaaagggttggcactgagctaggaagcgagaatgcagggttatgaaaaaggatccctgctttgggagctcatggacttgtagcagagaccggtagtaaattggcagtctcagtaacttctgtaaatgattgcatctctttgcaggcttctcttcccatactctcccccactcctccttggacagtgttccgggggttctttcctaagcaactgctttttcagtatacatacttcagatgattgtgtctactccaggatttccaacgatgctaggtttctttcctgtgccctagacgtataggtctaagttccacctggatatcccacagggctatcaagctcagttcatcctaaacagaacttacattcatccccaactcagacttccttattctttattattgaatggcagctctgtaccttagccaagctgttatctctaggtcatcagccttgactcttcctttttccttgcatttcttaaaattgccaagtcccatcaattttacctcctggatacctcttgaatctatttttttttaaagacagggtttcactctatcacccaggctggagttcagtggcacaatcttggcttactgcagccaccacctcctgggtttaaacgattcttccacttcagcctcccatgtagctgggactacaggtgcccaccaccacgcccaactaatttttgtatttttagtagagacatggtttcccacattggccaggctggtctcaaactcatgaccttaagtatccacctgccttggcctcccaaagggctgggattacaggtgtgagccaccgtgcccagccaaatctgttttcattactacctatatctgtattttcaacctttgtattagcatctagttagggatagaccaggacagggccgacatgttagttgtcaagcagattgccaccctcccccaccactgaggaggccaaatggagtttggtggaaaatctctaattcattcaaggtattatatgggcaagcaatggctgtggcacagggtcccctgattactttgtaagaatgggtgggagggatgctgattttcaatccttttgcagatcttctctcatagtaacacaatagaagatactttgccactatgttgtttgccaaactcactgtacctacttgactggtaacaaaagtcccaagagttacttgggagaagacacttgaaaaagtatttttctaaatatgggcaaggatgctgcccttccccaaactgttagtataccacctctctgaccaattttcccaaggaagatattggggtagggtgaggtgtaaagaaaaagtggtcatgtaaatactggtaataaaagctgttcagtggggtagagttgggttgcaactgtagccattctaaaaatgggctatcaatgtccttttagccaaaagactttagtatacatcctcctcattctaccctcaggatttggatctttgcccctgatgggtatccatcccctttgaaactttagaaaggcaggttatatacagaatgttcaacctaaagacatttccttaagtcatactttcatgctttctaaactataatcacccttatcatcccctgctgttatgctttccctctgctccctgtggcctaatgttcctccaccaccttattaaccttcaggatacttttcccctaggctgggcaggacaacactatccccttggtccacaagctccctcaaggttggggaatctttgtttacttagcaaatactgaacataaccttaaagcggttacttttgaaaacttctcatgctattctaccaacttggaggcacctatccatgctcattcccctaatgtagccaatatggttatctgcaatgtattggcatctaaaaactcccttatgaaactgccagacttgttctggaacatttcaattacatgcaaaattcaggttctcaagttggaacaagtctaattgacacacctgcataggttttaaccttgccctccccctacttcccaacagatttccaagttttttgagaaggaaccttgctctggcccaggctggagtgcaatggcgccatctcggctcactgcaacctctgcctcctgggttcaagtgattctccagcctcctgagtagctgggattacaagcacctgccaccacacccagcttttttgtatttttggtagagacggggtttcagtttgccaggctggtatcaaaccgtgacctcaggtgatccacccgcattagcctcccaaagtgctgggattacaggtgtaagctaccatacccagatttccacggctttttttttaagtctcactctgttaccctggccggagtgtggtggcacgatttcagctcactgcaagctccacctcccgggttcacgccattctcctgcctcggcctcctgagtagctgggactacaggtgcctggctaacttttttatatttttagtagagacagggtttcactgtgttagccaggatggtctcgtgatctgcatgccttggcctcccaaagtgctaggattataggctcacgcctatattactatatagtggcctatattacaggccactccgcctggcctccaaatttccaagtttttaagtctccatgcaaacaggcataagcaagcactccttggctctacatttgcaggacaagctggaccaccattcagatgttggtagaaatgtaatccaagtggctattctctatgcatgtagctcctaggttcaagagcagtgtggtctgcggattttctacacaacctgccataaatgaaatttaagcctttggaaatttatagcattttcagctaatttgcattatttatctctgcaagatattgactagaaatcacgtttcagaacttctcagatgaaaacatcatacaacccttaaaactaagctcataatttaaaaatgtatgcagatt

SEQ ID NO: 287 - DNA, 10000 bp, Homo sapien
ggttgtagataaagaggcacagctaactgcatggcagagaagattctgataattgctaaaacaaaggaacaaagcatggatacagaggagggaaaagtacctatgaccagtttaatctgggaaggcttcatgggggaaaggtggtaacatttgacctgaactttgaaatacagctagaacttgacagatggtaatagagagagcttccagacaaagagaataaccacctgaacatagttcataaggtggacatgtgcagagcatattttatgaacatcaaacagaccaggctggagtgtatagttactggaaggaacagtgagaaattaggccagaaagataggcttgagcttgaagttaaggacttaagactttatatcactattttttattatggaatgactttttcagaactatggtatagaaagatcatccaggccacagtgtaataataatagtcatcctttattgaatacctgctatattcaagcaaccattctaactgatttatatgaattaattcatttcattgtcatttcaatctatgaggtagattatgtcccattttacagatgagtaaaatgaggcacagataggctgggtgaccttcccaagtccaaactgccagaaatcaatagaaccagaattcagatcttgatttttggccccagaccccatgcccttaacacttaacactctcatagcaaagaagcagaaagcaggcaattagaagctatttcagtatccagtaacaagttctgagggctgaatggaaacagtggtttagaaagagaaagaaaacatgtatgaatgacatagtagaggcactgcccccagtttgctgtggagtggaggatggtgaaggagagcagagtcagagaagactttgtggcttgggatttgaaccacaaaaggcaaagtaaatttcaatgggaaggtgaagggttcagttttgaacatgtggaacataatacacatgtgatactatcttgcaaaatgttggaagtgtgggctggagaaagtttgcagctacagatgttgaaacattgtgggaatcattgaagccagagtaggtcaggccatcaggagaagcacaatctctttgatgccttgtaagataaactctcatcatttttctttttctggttactcaaggtataaaattcagttgttgatttgagatctttcttttttcaaatgtgaatacttatggctacagatttttctctttgcactgccttcacggcatcctataagttttggtatgttgtattttcattttcatttatctcaaggtattttctaatttctcttgtgattttgtctttaacacatatgttgtttaagagtgtgtgtttaatttccacatatttgtaactttccagttttccttctactattgatttctagttttatcttattgtggttaaaaaagatatgttgtgtgacttcaataattttaaatctgttatgtcttgtttaaatctgttatgacctgaaaaatgttccaggtaacacttgagaaaatatgtaccctgctggtgttgagtgaagcatcctgcatatgtatgttaggtataattggtttgtagttgttgaagttctctatttccttattgatcttctgtctggttgtcttatcaatttttgaaagtagggtattgaaaccttctattattgtaggcatgtgtacttctcccttcgagtctgtcaatgtttgcttcatatattttggagctctgatatctgatgcatacatgtttatatttgctatatcttcttggtaaattaactctttaatcaatatataataaccttctttgtctcctgtaaagtttttaatagtatgttgtctggtattagtatagccattcttaacggttttttgctgatatttgcgtagagtattttttactatccattttctttcaacctatgtgtgtctttagatctaaagtgagtgtcttataggcagcatataattggattatgctttttacaaaatacattatggcaacctgtgccttttgtttgggaagtttaaaccatttacattgaaagtaattagtaatagggaagaactttcttgtgccattttgttatttttctgtaagtcttatagcttttttgttgcttatttcctccattcattatttgggtttagttgattttcttgtagtgacaagttttgatttccttctattttccttttgtgtatattctatacatattttctttggggttacatggggattacatatagtatcctaaaattataacattctattttgaattgataccaaatttacttcaattgcatacaaaaactatacttctttgaaactactcccaatactttatgttattcaggtcacaaattatatatatagtgtacaccttaacatagatttatagttatttgtatgcactggttttttaaataccatagaaaataaaaagtggggttgtaaaccagaattacaatgccagactttacatttgtccatatctttacttttaccagagatcttcatatcttctttgagttactttatagcatcctttcttttcaacctgaagaactcacgttagcatttctcgtagggcagaactagaagtaatgcattttctcagttttcgttttgtctttatttctccctcatttttgaaggacagttttgctagatacagttgtgtgtgtgtgtgtgtgtgtgtgtgtgtgtgtgtgtgagtgtgtgttttattttgggactttaaatattgtacaattgccttctggtctctaaggcttctgatgagaaactaatcttactgaggatctactatatatgatgaataacttttctcttgctctttcaagattttctttgttttagcctttcagcagtttgtcttcaatgtgtctcagcatgggtctttttggttttatcctacttgaaattcattgagattcttgaatttgtagactcatgtcgttcctcaaatttggtaagttttcagccattatttcttcacataagctctcttaccctttctctcttctctttctgggactttcacagtcatatattgatcctcttgatagtatctctaaatcccttaggctctgttcacttttctttattcttttttctttctgctcttcagacttgataatttcaaatgtcctattttcaagtttactgatactttcttctacctattcaagtctgctactgaaaccttctaatttatttttcatttcagtttttgtatttttcagctccatcatttgtttggctgattttataatttctatctttttgttgatacatttattttgttcatatattgttttcctgattttctttcattctttttttctttttttttgagacagggtcttattctgttgcccatgctggaatgcagtggcaggatcatggctcactgaagccttgatttttctaggctcaagcaatcctcccacttcagcctcctgagtagctgggactacaggcacatgccaccatgcagagctaattttttttttttttttttaacagagacaggggtctcgccatattgcccaggctgagctcaagcgatcctccttactacagcctcccaaagtgctaggattacaggcataagccactgtgcccagcctcccttcattctttatctatgtttttctttagctctttgagcatatttaagagagttgttttaaattctttgtcatatgtctgatccttgtgtttcttcagggatagtttctgtctttttattttatttctttgaatgggctatgttttctgatttttttgtgtaccttgtgatgttttgttgaaaattgagcgtttgaaaaacaaacaaaaaaacaaacaaaaaacccataaacttctcccagtcttcacaggctggctttgtgccacggccatcctcatctaattagccaggcttgtgttctgagcctttggatctgtctgaggagaaaggttaaggtctcctcaggtcttttctgagcgtgcatcttgcccggatgtgcatggcatttctatcaccccatatacacagctgtttatacatgtcttaattccccagagtcttacctcagtttctccttagggacttaaattgtctactctccatttccatctgtcagcccaggtatctacaagtcttagtctctctgcagctttcccaagcagtgcctgctacttctcactgcctcagctctgagttaggtgcaagagaccaatcttcaggaagccctcagataagttaggacattgtgaataaggtccactctgctccctccaattcaagtaatgggattgagaactgccatctccttcagaccaagatggtggcatgtcagaggaaggagggaaagggtgagtaaaaataccacaaaattttctaccattttaaaattgacttatttttgattgggcattttcttgactgctgtagacctttgactgtttttcatagctcatataagaatactttatcctgtttttgtttttttgtttgtttggttgtttttttgttgttgttatgtctctgtgagggaacaaggcttgatactccccagtgtaccattttgctgatgtcactctccattatcatttttgtgactccttctggctgctggatacccttaacagaccaaaacgaaggcagacaagagagtcaaaaactatgtctcttttcatgtgccataacagatgaatttttcctgtgaacagtgtctatgctactcaggaatgacaagctataaagaatgagcatatataaacagaggccttggaaagccccaactctttaaatcttaaccgctattccaaaacatcaaacaaccctatccttgtataaccctaatgtgaactttgattttgccatggttgaggtgattttgccatggttgatcccaaagcgtatcctgttctggataggcagctgtgaaaatactaactttcttagctcgggttcccctgaaagcaaagtcgtttatctgggaggtgattccaagttgcagaaatgagggatgaaagagaatgagaaacagaagaagaagaggccaatataagaatgatgcactgatgctgctgccatgcacattgagagctaaattttgctgatattcctgagaagcatacagaatcatcaacccccaggaattgcccacagaacagatgggaagccagagtatttattaactgtcaagggtttcccttggggaaattaactccttctctgattttcctctgagctgcacatgtacctggacctgtctctgaggtattacactgcaggtggggcagtagtggagtctgccactggtcaagggtgtgtgggagctggctaaagtgatactccgtggcaactggggatgctgatgtgtgttgggaagagtcaagatgtccatagaatggcagtcaggtgacagcctcataagtatagatgaggtgctctaccaaacagaactcaacagtgtaaatgtagaatctcatcttttctttttctcctatttcccttctctactttttccttgtcaaatttcatctatttataaagaatagtcacgccataataatatagaactgaattccatgcttttccaagccactgcagttacacaagttggccccccaccaccttgttttcttagcttcccagtggttattaaccagagatatatatttcaatcccacagagcagtccttagtatattcttgggcttttcagggtaaccttctatatgttgaggaagcaagaactcaaggttttccaaaaagctgtgggtccaagtggttaatctgcactggtttgcattagtttacgtgtgggaaatgcaacacaaaggaagtgcccagcaaccctgcacataacgtgcaaccattcattctgactcttttccctgaggatttctcttggctgaacagcaagctctctgggctctgcaactagagaacatctctaacataacataaacgttgggcagctgctgggagctggagagggctcagtctgaacagctgtgtgaggtttgaccttggggaaaacaacaccaaatcccaccaccataggctggtttccatttggacttagtgcaaatgaggcataataacaattaagcagatatacttggaagggaaggaaattaaaaaggcattttatgtggggtaagaagagtgggtaaagagaagaaatttcatggatgatagctgagggaagcttttctggaactgatagaggtaaaaactattatgggttgttagctgtatgagagtaggaactttcacttttcctttatgtgattctgtactgtttaagtacacttgcttattacaaacatgcccgattttctaacccatccccctagaacacagagagaccctgcaattgtagaagtgtagacatgtgaaaggagaggggttgaggggtgaagctgtgttttaagacagccacaggcactgattagacagactgggatgcttctttgagtgggatactcactggtaaacatcttggctaaaagatgtcctgggaaagattatatgaggacttggggctttaaatcttgggagaagacttttgtaagatcacttgaaattccctaggaattgcttacagcgctatcataaaaggaacaaaaaaatccatgtgaaaatattaatcataggaggctggaaaggcaaagacatttgtggctgtggacaatttcaaataaattttgttgccttccttaaacaatgccagctgtgtgcctgctttctcaaaccaagatgaactgtaagagaagaaaggggaggaaaagtccctcccgcatacagacttcaagtgtgtctgaattaaggcggctaaattctattattttcatgttcctcaaatcactattgcagggtggagctcataaaggcataataaatgtttgttcaactaaatatttcaatgacccaaactctatgtggattaagaaaattaaaattatgttcaattttcctattgaatttgaaggctgagactttactaagctttcccattgtgtttttaagtggtttcttaaacaagttgacccaaaggcttgggtcattcaacgaatgtgtttgcttcatggcatagcttagcgtgagctttgctgtcagatgtgagttctggctccaccatttactagttattcgactgggaaaatggtttagcctatgtaaaagctaagtttcttcagttataaagtgggtttaataactgtacctaatctatggaagtttggtgattaagtgagataatacttatagaatacctacctcagtatttttcacagagaaagcaatgaacgtgagttgtagttggtcatcaatatcctcctcctcttctccttcattatctagaagaggggtgggtaaactagggcccactgctagtttttgtaaataagttttattggaacacagccatgtccatttgtttatgtattttctacagtggctttcattctacagggcagagttgagtagttgtgatagagaccatatgacccgcaaagcctaaaatatttactatctggtcctttacagaaaaagtctgctgatccttattctagaaggaagaaaatctagggatgtgtttgtgcgtttcctgagcttaaattaccaggaactcatagctttgattagaagaaactagatgaagggtttgaataaacccttaaagcatgaaacattatgttttcttcatagatttaaaaaatatgcctagaggcagagatgctcacatgctaagacagacatggggaatctttaaacctaaacattttacctgaagagaaagaacagttagaatctttcggcttaatagaaaagtcacagaagcaagcagagaaatcctaatgagttagaggacaatcatttccaaggattttgagtgtgtcttaagttattttattgaaataaaaattccttttctgagttcagaggcataatctggagaaggtcagagagcacttatagccaggaagtgtttgcacataataacagatatgctatttgttcccaggaattttttttctttaaacctcagagttaacatagtcaaatacagagcaagtggaattcctgctctgtatttctaaaattgtctttttagactcatagtagagaaaacaatctgaaaaaaaccacttggaagaaagagtgactacagttgatgacaacagattgaaaagagaattaaaaagggtcaaaaaacccacaaggctttcaagattagataaaaactgctctgggcagatgagctagagagggtaagaaagagagaggagctgcctaaagagaagggttggtatggctcaacatgaggccaggggaaccgtaaggacagggttagtgatagcattagaagttggctggcctcaggccacaagcaccacccttcactggggctttgtgagccacacgagagttgagtgagggtcccaccaccatttcccgaacacatgacatgtgtctcttggcctaaggggctatgttagatgatcttgtccagaaggaatgatggacggccctttgtgcccttaaactttgctcatctcttttcaaactaccacatataattctcacgttaggggctaagggtgtgtgtgcataaacagagagtgggacctgggctactgcagggttgaagtaaggtagaaataacagttcccagtgtctgtcctggggctggaagacagtgcagggttgatgttagctgtagatctcccccaaaccaagactgtggtgggatccaccctgtggaacatagtaatggttaggaggatgttaagaaattgatatgcagaagttcccaagcatttctcatttgcctcttagcttgtcctaaggtgtataacagtgatcatgtaaagcactggaaatactgcttgcagggcaagtgctcaatgcatgatcgctagttgtttttttttcagggaaacagaacaaatatgttagatatagatatatacaaggggggatttaccacgggaattggctcacacaattctgaaggctgaggagtcccatgatagccttgtctgtaggttggagaaccagagaagctggtggtatgattcaatctgagttcaaaggtcagagaaccctggtgggggatgaaaagaggaggtgctgatacaattcctagagttcaaaggctcaagaacttggagttctgatattcaagggcagagaagatggatgtaccagcccccaaagagagggaaaattcacccttcctctaccattttgttgtcctcagtggactggatgatacctacccaacactggtaaaggcagattttctttatttagcctattgactcaaatgctaatctcttccagagacaccctcacagacatatttagaaataatgtttcaccagctatctgggcatcccttagctcagtcaggttgacaagtaaattaacaaacacattgttattatttttacggttgaaaccaaactgaaaactttgttttttgctgtttagcaaataaattctatttgttttttaaaaacaaacaaccaaaaagcacctaacctgagaagtcagcacagctttcagatcctcacccctagaaagctcttgtcctggctgctccctcctccttgctctgtgagaaattccttatgcagctacgtgcaggaactgactgcgcgggatgatccgtgagctgcatgtggactaccccaatctgctttttgttcctaattcctgaatgagcaactgaaaattccccatgtgatcactccctctaccagctcttgctttcccagaaacactaggcttgctgttttgtacatttgcaggataaaagaaatgtaaacatttaaataataatgtatttttaaaggcataacggggttagttaagtaaaacaacccatctcacatcatctgcagaagaaatctaataagttttggggttcattggggaaccagagaatattcaattttatgacaggattaagtttt

SEQ ID NO: 288 - DNA, 2190 bp, Homo sapien
tgggattcccacccacccacagcccgccatggcgtctcagctccagaaccgactccgctccgcactggccttggtcacaggttgagggggttctttccccgggcggtttggggtattggagtgaggtcaggggcgtgcccttggagtgcgcggccgctgtgacctctggccccttacccacattttactttctgccctgtgacctctgatccctgccctctcctccccgtgcccggtccggcgtgttctgtcctacctcaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggtgaacgctaggccactttccccctctaaagctctgatattgcctccactgccccggctttttgtggggggtttttgatgcgtaacctccccctcccataggcctgcttttctcgcccaccatctgtcgttgtgtcctgtgcgggcatcacccaggatgagtttctgctgcacatgtctgaggatgactgggacaaagtcatagctgtcaacctcaaggtggcgatctctgaacctgcgacgtttggcccccttagcctggggagggagttggaggagggctgtcaccccagctgatcttttctcccttgttaccctttcccgccagggcaccttcctagtcactcaggctgcagcacaagccctggtgtccaatggttgtcgtggttccatcatcaacatcagtagcatcgtaggaaaggtcaggttgagttggacgaggtcagccagccaagtggtatagagaggagaacccctccttgagactcctgactcattccacatctctgactcacctataggtggggaacgtggggcagacaaactatgcagcatccaaggctggagtgattgggctgacccagaccgcagcccgggagcttggacggttggtcagatgcttgagggtgctggggagcacctggggggtctgagggaggtaccagcattcagccctctccagaatcggcagccactctccttcccacagacatgggatccgctgtaactctgtcctcccagggttcattgcaacacccatgacacagaaagtgccacagaaagtggtggacaaggtaggaggctgtgggtggagggcagaatcattcagagactcaatctctctgggcttcacagagagagagagagagagagagagagaatactgggcacagttcctggcaaacattaaatattcaatgaatgtatgagaaatgaagacaaaaaagggtcacagactcagtcttcaaaaaaatccataaaagaagctttcacccacatgagtatttccttacagattactgaaatgatcccgatgggacacttgggggaccctgagggtgagcactgaatgtagtggggtccctgggaagggggcctgaatgaagagatccccaaagtttggggattttctaggggactggtggttggtgtctgtggagaggtttgtggggagggatgtctttggtgggagattatggctgttttgggtctatgggagtgagcagaattctgccctctccccaccattctcatagatgtggcagatgtggtcgcattcttggcatctgaagatagtggatacatcacagggacctcagtggaagtcactggtatgaggccagcatggggagggagagggcagagaagtagaacccagactatatgagaaagcaagtaaggggagtctggagccactgggaagggcagaggttcccaaggccagggacagaagtgggtaccccctagcccatttgtgtctccacccatgcatctgtccaaatgtttctgcccctcccaggaggtcttttcatgtaactgcctcaaggaccctggactctgctcacccccccaccactctgcctggcctcctgctgatgaggactctaagttcccaggatacaaaaggggtggcagtgtatggttcaggaatgctgaatatgggaagcaggggtgcttgtgaccctaataaattccaagtcctcttccctgcc

SEQ ID NO: 289 - DNA, 6245 bp, Homo sapien
gcttatattataaaagcattttattgaacacattctggaggtagttagaaccaaaacaaaatttgggattggggtggggattctgttttgatgatttagatttgggaaaactttgggttctcgtgtcagcaggggccatgctgtgggaaacctgaaggctgatttgaagcagaatatagaactgcggcacgggagaccaggggctgggaatggggctctcctgggaaccaaagaatgtggttctgcaattggcttggtctagactactctccagaaaaggataaaacatggcttgagcaactgcctagaagaggcaatctccatgggctgggttgctgcacttggaaggcagtgacttgcagcaggttcttagctcttgaagctcttccgggaggaggaggtggtggagacaaatttgacgctggagctgctacccccgccactgccaaagcccacccccagccctcggccactgcttgcactgaagccagagccccccacactgagcccaccacctaggccgacacccccactgctgctggagtagtagcttccactgctacctccggcaagacctccaccgaggccgccgccaagacctccaccgaggccaccgccatagccactgccactgccatatccagaggaaacactgcttgtgacaacagctgcagggaaaggagggaggactcagtgagaccatctgccaggctgatcctgcatggcccatttatttgatctgctggtgttggagcactctactggaccccctttacagagtagcaaacaaggcccggaagaactgtcatttaattaaggtccctaaaaaagtgggtgagtgtaagaggcaaggtgctaggtactgagaggagctaggtactgaggggagctaggtactacagggagctaggtactgaggggagctaggtactgaggggaggagctaggtactggggggagctaggtactagggacaaggcaggggacagggtccaagaagcataggatgcatggcttaccctttaagagatgagacataagccacattgcttcctgtcccaatctgtccttcccctccaccacccacaacttactaagtgtattattataaataaccatatgctgggatgggaaaagtttggatctagaaacagcagaattctgagttggcactaaatatatcccatattattgtcgttgttaatgtctgttcaaagctacttacagatgttgactggtccaactccttctccactgagtctgaaaggggaaaaattgaattaagggttaacagctcccaaaaagacagcattagtctatgtggctaactcccatcctcatgattcgagttcattccataagccaggagtctgtacacccaaaagctgcttaagttaaaggaagggagaactctccagagggattttccaatgaagagggattgacctagaaacaagttgttaggaaagaattataattcacattcttctccacccactatggggaaagtataagagatttggaaaatgtgattatgtcgaaagcagtttttgccttgtaggagttacattctgtgagagaacttggcacggacagaaattcctccaacagaaagtaggcaatgggcaatgtcagaggttgaagcaaacagtagtttgacaatccaaaggtagctgagtttaactcagctggagtaaacatgaaagccttcctgaaggaaggggtactggaggacaagggtggatggaggtgggcatgacatggatattgaggttgagcaaaggacgtgagcaaaagcagaaaaggcacaagtgtcaagaagattgctgagttgctcaggtgcttggaggacagccagtgcccaggaacaccggtgggggaaaagagaccagaaaagtgagttgaggtcagctatatggccatgagtcagactgaaatagtgttgatgatgtgtcattatcacgcacaagtcactgatctcatgtatgtgtgttgtacaccccacagtagagcagcttcgctttatcagctgaaggccatcttgagttcatgctgtctactcacctgcattcctcgccctccagcagcttgcggtaagtggcgatctccacgtccagggccagcttggtgttcatgagctcctggtactcacgcagcagccgggccatgtcctgcttggccttctgcagggcctcctccagctcggccagcttgttcctggcatccttgagggccagctccccacgctgctcggcatccgcaatggcgttctgcagattggcgcactacagatagaaaggaggagagtggggttgcttgggacctgaggtgtctccttctgagtttctgggtcagacaaaccaaactatcatgaatcccagagagaaaccagtacatcgtgggtggcaggacactgaaacactggtactggatctagctgcgtgtgtttagcaaaagtaaaacaaaataaaacaaagtaggtgtttcttttagaactcaggccccttccttgccctctttcaatctcaccctacctgtttcttgacattgtcaatctcggctctcagcctctggatcatccggttcatctcagagatctcatgcttggtgttgcggaggtcatcgccatgccggccagctgtctgctgcagctcctcatactgatgcagccaggaaagaggaaagattctgtttatatgagaatgggaagaactttcccaaagttcacaggcagtgagtactaagtggtggcaaatagtgtggggctggttcaggcttttccaaggctgagctagtctagtgcctttgctctcctggagacactggtgtgagattcagagtgagattatttctcaggtccttgggtttagatggaaattgtctacacagccattcctataaagcatcccaatgggcttcagcaggttccaggagccccattcttagtgtcgtcatggcctagaatcctagacatgggtgtgtcccctcactcaggagacagtcatcagagcacccaccttggtctgataccaggactcggcttctgtccggctgcggttggcaatctcctcatactgggccttgacctcagcgatgatgctatccaggtccaggttgcggttgttgtccatggagaggaccactgaggtgtcagagacatgcgtctgcatctgggacagctcctgcagggagatttggagtcggtcatctggttctgtgttgtgttatttaatgtcagttccattcaaatctttcactcattgtgatatgacaacttgaggaaaaaaaacccacccatgtgaaaaatttagataagtttcttaccgcatcaaagaacatcttcatgaagttaatctcatccatcagtgcatcaaccttggcctccagctccaccttgttcatgtaggcagcatctacatcctggggaaacagggatgattggcactgcacacaccgtcaccctactcaagtgagctccacgcttagagagcatagctgcaggctgctggttctctcccacccacacgcaccttcttcagcatcacaaactcattctcagcagtggtacgcttgttgatttcatcctcatacctggtggtgaaagggatgggaagtgtttgtcagaggatgagcaacaggtaaggggtctttattatgcagtcaactgtaagcctacttttgcagtgggaaggggcttctcctcataggcagagagggaggggacactggtagcatgaacctctggccaaggtccctccccatttaaatactgctttctctgtaactgcctaccatataataattctattattgctctaattcagttgtttcaagcagattcctgcagaaaagctgtgctgtttctccccaactgcattacctagtcaatttctctagtgttcttttttgagctttcagaggctttaaaaaaaaaaagaaaagaaacaaaattaaatctagcatcctagttgctggttcataagactaaagaaattacttgagccaccaagctgggttatgtcaccagctcctgctttgagacaaatctatccaaaggcccatgtaccggggaggaaagtcccagagagcaagccttacatcagggcagatttcaccaggtagtgccaagggcacagagcatgttgctctggctgttgactaagttccttgcagagggcctgagcctggggctggaactttctaaacatgagcctggcttgtgtatttgtttgtttgttttagtactggaggtgtccatggaaggtatatcctcccagccccaaaggaaggcatggtagtagactagtaacaaagcccatctggtaccaagaagacaccaccctcccctgtgtccaccctccaccccaactcacttgttcttgaagtcttccaccaggtcctgcatgtttctcagctctgagtccaggcggccccgttcccccacgatgctgtccagctgcctcctgaggttgttgatgtactgctcgaacaacggctccaggttctgcctcacagtcttggtgccctgctcctgcagcagggtccacttggtgtccagaaccttgttctgctgctccaggaaccgcacctggaggggagcagggtttgaagatagagaaacttggatttcatgttctatgatcaactcactaaggtgcctcccacctctttccgtccctctaaagcttttctgtgcactgtgcctggccctgggccccaggaggggaggtgcagactgaggcacccaaactcacttttccagggggagataggacacctatccagggcacagaaagcactaggagtgctgcttggagtgtgtcccggctcaggggtggctgcaaaggcactcaggctgctgcccatgcacttgtctaccttcctgtacagtcagcccctttatatatggcatgaaattcatctctctgtccaacagttgttaagaggcccttgtgagctaacctctgaatgggaagaaataattctcccttcccagctgccagtctaattcagaacgtgtccacaaatccagggcacagaaacaaacggaaacacagaactgtacaactataaaagtatttgcacaaagccaaaacatcttccttctttctctctctttggcatttatttcagacccacagtgattttttacaaaagatcgtagctcaccttgtcgatgaaggaggcaaacttattgttgagggtcttgatctgctcgcgctcctcggtcctcaccctctggatgctggggtcgatttgcaggttgaggggagtcaggagactctggttgacagtgacctcttggatacctccaggagggcagacaggaaagccagggccaccgaagccacctccaaagccagctccgccaccgagcccaaagccaccaccagctccaccgccgaaaccaaatccactaccggcaccacctccaaagccatagccgcctccagcaccagcaccaaaccggttcctgaagctgccaccactagtgctgatggatatcctcttggagccccccaggttgtagaggctccggctgccatagccacccactccacaagcacccgcaaggctgaccctgccgaagccaccaccaccgccacccccggaccgggacacggaggtgaagctggtgcgggagacagacggggtgatggcagaggcggtgctgaagctacgactgcccccgctccggaaggacacacttgactggcgagacatggtggcttgttcctggtggagcaagagaaccaggcactagtgggttgggaggtgctggagagaacagagctcagcaggacgcagaaggtggctctgttacccaggaacggtgatgccccctttttatcccttccagaactgggctgggcgagagagctgtcgagctgtgaatgattaagtgggctgggcatgcctggggggcagctgtgagctcaccggtcacacctgcacagtggtgtggggtgcaaacgctttcttcctggcaggctctgctcagttagaaataaccttgccttgcagcactgatctcttggcagcaagttggtgacgctgctagcaagtatgtcttcaccatagaggctgggggctgtgagcagcccaaaaaggatgccaggaactgagggggcattggcatggccagtgtcctggggactcttacaggaccaggagtattgacaaccatcccagtacggtacatgctgagcacctgcccttccagcttggggaagctgtccatcagc

SEQ ID NO: 290 - DNA, 2320 bp, Homo sapien
gacctgatcaataaggtctttattatcaccagttagtgcaggcaaggtaggtgattccagtggagggtgatttgtggcctcaatggacacatcttaggggttaaacacagacttgaccacatccacaaggaatgtgcatcttcctgagctcaaattagatttccctcaaggcccctcaaccagcatcggttcagctgagcacagtcctgaatccctagagaacacaggaaggaaggctcagggtactgttttccccatgcatgaggacaggactgctgcaaatttttggatccaggcaagatggaaagtgactatggcttctgccttatgctgcatgggtgagatggccctgcaaaggttcctgggctggtcagaaacagagtagcttctgaaggcttttccacattagcagtacatgtaggtaatttttctggtatggggattctgctgcatgaagtttgacttggctgaagattttctcacaaagaccacttccataaggctccactcaggtatgaatctttttatgctgtgcaaggttacaaagatggctgaagagtttcccacactggctacactcataagtcctttctctggtgtgaactttctggtgccgaacaagtgtagatctttcactaaaggcttttccacactggatgcactcatagggcctttcttgtgtgtgaactctctgatgacgaaccaggtgggagttactgctaaaggctctcccacattcactgcattcgtaaggcctttctccagtgtgaactctccagtgacaaataaggctggattttcggctaaagaatttcccacattcactgcatttataaggcttttctccagtatgaactttctgatgcttaatgagaatggagttttggctaaagaatttcccacattcattgcactcataaggcctttcttttgtgtgaactctccagtgttcaatgagagtggagctgtgagcaaaggctttcccacactcactacactcgtaaggcttttctccagtgtgaattctccagtgctgaatcaggctggagctgcggctgaaggatttcctacattcgctgcactcataaggcctttgcccagtatgtactttctggtgctggatgagggtggagctattactgaaggctttaccacaatcacagcattcaaaaggccgttctccagtgtgaactttctgatgtcgaaggagatgggagctttggctgaagtctcttccacattcactgcactcaaaaggccgttctccggtgtgaactttctggtgctgagcaaggttggagttattgttaaaagctcttccacattcactgcattcatacggtctttctccagtgtgaactctccagtgctgaatgagagcagagcttcggctgaaggatttaccacattgactgcactcataaggtcttacctgtgtgtgaactttctgatgccgaaggaaattggagctttggctgaaggctcttccacatttcaggcactcaaaaggcctttctccagtgtgaactttctcatgccgaatgaggtgtgatctgttactgaaggctttcccacattcatcacactcataaggtctttctcctgagtgaattctctgatgatgaacaaatgtgagtttgtggttgaaggttttcccacatgcaatgcactcataatattttacttcagtgtgaaatttctggtgcttcctcagcttagatgagtgactaaaggccttcccacactccttacacacatggggtatttccccagtgtgaaattttttattaccaaggattgatttctcctctaagaaatttccacctgttgggcatgtaaatggtatctcttcagagtgagttctcagatggttggggagagtggagctcttcaggaaggcttttccacagttgctgcactcgaagagtttctgtgtggtacagacttctggaagctgcccaagattggaatatggcttctgcccactgtcaacagcttgaagctggaggaggtcacagctgcccaggatgaccttcccaccttccctgcaagtgaaggggttctctgacaggtggactttagagctcttcataagtgcgtccctgtccttgtaccatctaaagggcttccctccactgtgctccttctggtgctggtgaaggtttgcattcaaccaaaagtctctcccacatgctccacatgtgtagggtttctcctcagactgtgttccctgatgctcagccaggtgcaaaatgtctttcaagaatggcccacacatgtcacaggagttagctttcttggtggaaggatctgcattagg

SEQ ID NO: 291 - DNA, 7073 bp, Homo sapien
gtccagaaaacagcgattttaatttgaaagcgattttatgtatgagaggggaaaggagccccaaagagaagggacgcagggcaaaaatcatgcagccccagcaccccacctctgcgggctggccacctcccctcaattctcaggccaggatcctgtgtccccagcctatgctatgtgcccagggctggaggagagctgtaaagggaaggcctccgggactacactcgtgaaaccatcccctgtgggggccctgtcctcacagcccaggccccttccccaagttagacaggaagagatagggggggcggcgggaagctgggaaggctagtgcttggagagccctagggacaggccatttcagggccctgcctttcccaaacacccacctccaccactggcatttcttagtcaacctgggaaagtacagtacttctttgagtctaactgcaagtctctatcctcacaggaaattaaaaatagcagatcggttcctacatctccaccagccccttcaccaccaccaccaccttttttatatttcagtctgactgcagaaggaggtgaagtgtaaaaagagactctggacagtgacagggcccctccctcttccagagaggcccccatctgccaggtttgagaggaggaaggcctgtcagggccctactctcatgtccatcagcttgggaggcctgccccccagtatccacctctgggggagttccccatttccactcttcagatgggaagcaaaatgaggcaagatgagaaggaagcaaggtcctggaggcaaggccagtgctttgtgctgggggaaggacagagggtgagaaatcaccccaaatcatgggagaacccgacaaattcagagactcaaggccaccgaagagagacaaccagtcctcacaggtatctggggtcccttccaacttgggatatcaagcagatcccttggagggtttatgttcttggttctgccctgtacttctcaccccatcaaggttctgggaacatggccccccaccctgccccagggcttggagtccctcttggatgtgtgctcctccagtgtgagaagcaccacgtctgggtctgagctcaggccagttgatggggagcctcaagcatctccatgaggaaggtgtcgatgggggtgtcaccaatgagcttgaagaaaaacagatgctctagacacttaaggccaatggaccggagggcaggaagacgtagcagcagcttggcaaacctggggtggaggtgggagaaggggattgagagctggaagcacacgggccctgaacacatcctcatagcactccccacccccaagggagcctcagtgccccccagccccatctcaccgtccctgctgctcagggtacttctgtttgcagtaggtctccagtgatgcatacactttctcccgcaggacctccacctcactagggttggagaggcccttggcatctgggatggcagggaagagaggaggaagagaaatgaagacaaaccaaatcaggatggccatgcagatgtgagccacaggatgccccttttgggctgcacttgcttgccctttaccagaggcctggcaagggaagcagggcccactgggtttgtgggatggatccgtggatgtgggtttttcctcggccagttgggagatttccaggttgagggtcttactgagggggatagctgggtaacttaggagtctcggagaagaggaggctccaaggttgccttggccttgagagacaaaggtaatcctcctcttacctggattaaacagaatgattgccctcaggcagccaagctctgtcttgtccatcctcatgtcacgcattttggacactagctctgtcagcaccctggagagggacctgcaggtcactcaaaggtcacagctcagccagccttggacacggaccagcctatagccccaccccctctatctacatgccagcctagccgagggccactgaccgatcaaagatggctcctactcctgctgaatgggctgagttgcggtgcacgtgaagacctgtggcaaggaggatgccatctcgaacatcaatggatcggtgtgagaaggaggcaatgaggagttcattccagcctgggtggggcagcaagggtcaggagccagaaatcaggccaagggattcaaagcacatcagtggaagagaaggagaaaagaggtggcgaggtcagcaagtttggctccctgggtacgcaaggtaaggccactggggtcactaaagatcgggaagtcaaagaggggtcaaatgtcaagaagtcaaagggatccaaggtcactgacctgcccgcagcaatatgacctgatcatccagaggcaaggaggaaaagtgtgggatcctcttcgcccactcaacaagcgtgaatagctgtttgtcagctgcctgacagatgttagtcacagggtcatttggctgcaggggacgggggtaagagttatggaagattttgagatatgctgggagcccccttgtaagaggcttttgacaccccctccttacatatagtcttcctgtgagccccatccaaaccaatccctgtaagtgagtcttctcttctggcattagtgcaaacaattatttatttgggacatgcctatggttctgccagtgggttgtttggggagtggagacagaaggagctatcacatccacctcagatgtttgaaagaccttgtttggcagcacctccagtcccaagtagtgttaggaaggttatgaggggaaaggagggggaggggatgtagaacagacctagactgcctcccccaacccccatcacgaaggagagtggattgaccccaacactcacgctgctgccgctacccccggttcccccaggaccctcaacgccctggtcactcttctgttccacagcaagctctgcctccaggatcctgtccacaggcatctcctcgggggctcccccagccccctccccatccccatccttgtcctttccccgctgacgctcctcctgtaccgctgcagggggaagggggagagaaaaaatggaaagtcagcagccagccatgaaggggttccacaaatatccttacggcctcatcaggatctcatggcccttgggagatatttataggaattggggaagtcactagaaagggtggactgggggcagccctgaaggaagggttataaaagggcaggtaagtcagtcgggaagggtgaggtaggtaaaagaattagggaggaatttaaatggagagcctactacatggttaaaaaaaacatgccaagattcaacctgagaaagctgattgaaaaaaaaaatttttttaaataaaatatgccaagaaacatgctaagcacattttaccattcactcaattatcataatgatgctggaagcatttattctcatttttaagatgaagaactcggggttcaaagagattagtttgcttaaattcatataatacatggcaggtcatacaactgactctaagtgtgtctgagtgcaaatcttgtgctcttctgactcaacaaataggcagtgaaaggagcactggcctaggtctttgaagatgtgggttctgatcccaaacctgcctgccactcctttgttgcatgaccttgggaaagccaagcctcaggctcatcttctctaaagtgggtgttttgaccaagatatgctctaaagtgtctctcagaatcctaggaatctgacttaagaagataagatggagacacagaagaaggaagggaagccctgaggtcttcagtaaagtctgtaagcttaagagtgcccagtcccaggagttagaggaaagatcacagataacaggagacagagaccagagaaggtccatggaatcagaggaggaaccactcaggttagaaatggggagacagcccatcatggctaaggaaaagttatcctatcctaggatcagtctagggaggggtcatatgtgcaggccacagaggcctaaccattaagaaggaaactcaagggccagaacagggtaacagggaggagagctgcgaagggagagagaaatcaaatatcgccctctagaggagagagagcagtccacccttccagagaggtacacagtctgagtgggataagggagaagggcatgtggtctaagacgcctgggcagggcgggtccttaccctccctcttcatgccagtggccaggcacttctgatagcggcagtactgacagcggttccgctggcgcttgtccactgtgcagtctttgttgtcccggcaagagtatgtaaggtctttgcggatggtgcgtttgaagaagcccttgcaaccctcacagctgtaaaccccgtagtgtttgcctacagggaaaggggaggagcaataagaaggttgcatggagacaccttcaccatttagtctgtttccaatctccccctagcaaaacttaaagtcctccctgtttgccaaatacagagatagggaaccaggagctgagtgatgatccagtcccagtctcctcactgttcagaaaccctacacgctgcttccttttccctctgaccttccccccaatcgcgtcctacatctcagcttcagcttctttactcccatcaggcctcccccaggtcacttgctctgaccaaactccataagccctgggaatcccacaggtgatgatacatggcccagactctccctctctgttcatcctctgagccacatacctgagcttctgtccccgcagattgcacatagccgtttgccagccccagggccacctggagggggtggacagtgcaggccccggacccctaagactggtggcttcacatcttcaggggggccagacccacccccagggagtgacactgttgagttaatctgggatgggggaaatagggaagtcacaggaagacttattgggaagcagaatgtcacagaagtgatggaaatcattccctaccactaagcaaggccctgcaatgcacattccagaggctgtcatttacactgcagtctatgtgaaaggccatccctggagcacaaccccaaagtgaataaacaggccccccctgaaattgtgcaacacagtgaccctgaagggcaggtgtcttgggaaagcagatgggatcaaaagggcagaaaatcagatagatgaaaaggacatcaagaatatcagaattagccgggcgtggtggtaggcacctgtaatcccagctactcaggaggctgaggcaggagaattgcttgaacccaggaggcagaggttgcagtgagctgagattgtgccactgcactccagcctgggcaacagagcaagactccatctcaaaaaaaaaaaaaaaaaaaaacacacacacacacacaaaaacaaagaatattagagttcttttaggggaggaagcatgcactgaaagatcagtcacctcaggaaaggcaaggggtctcataaagaccacaggcctgacaaggttagaggattggaaggtcaatgggccatggggaagttcacacaaggatctggggttacaaggaaaacaagaaaatgaaagtggccaggcagtaagttggtcacaacctctcacctgggggctgctgacaggcccggagaatcctgggggagctggagggggcagaccaggggaccccatggaagaactgatgactggaaagggagagcccagtgggggtggtggcatcgggggtgggggtggggccccagagcctccaagggatggagctgttgaagggggtaggggtggcccaggaggagaagggggagggactccctggggaaggggatttggggaggagctgtctgggcttcgggagtctgagggaggggtatgtacaggcacacagacacacaagagacagaagagacaaaaaaagaaaatgagtcttcaaacatccaactagagactttaattctctaataccccaccgtgccggacccagcccactccacccatccccaagttcagagacaccctgctgtcaaacaacagtgtaactccggctggtccgatggtagtgggttatcagaacttattaacatttgtgtcactaaaattggtatacaacctcccactgctatatttgactggctaaaaaaacccaaaaacagcgtaactcctcattgtggtgagaggagggagttgacaaggagaggaggatagttcaggtgaggaaaattttccaaccaatccatttgaatgaataccaggtcatcccaaagccacacctgtctcgtgggtggggcagcacgtggggtagaccatcgagcccctctattcccagcgtaaagccaggtagccagagcgtgcaagggaaagagacaggcaggagagacccctcctaagacgcaggatctgcctgtaaacgcccaaagtcctgaggtttaagaggaatcgtgcccttcccaggcccgcgacctccggtgcccaaggcctcaagcggtcacagctaggagggcggaagctccccttccccgccccgccccgggggggagggtgctaaggccctcgggagggaggggacgcgtgtttacaaacaagggggcgggagcgcaaggaaaagagcaccgggggagggtgtgggggaggggtcgcagataaagcggtcactggctcgcctgcccttctgctggggcactcaccccgcccgctgtcgcccatcccgtcccgtccagcctcccctggctccggctccggggtttgttgttctccgcctgccaccgccgccgccgccgccgctgcgggatccagccagggccgtcgccgccgccaccgggacgcgaccccacaatgcatttcttttcgcacccccaccggcccacactgccctgcggcatgccgctgagggaggaagggcgggcgagcggcccaagacatgatccctggctgagagtagggataccgaagaggtcccagggattcccaaggattgatcggaggattagctgagcacgaggaagcccctgagagaaagactctggcctggattgggtcgaattaagcccgtcgctctgctcagtaccaaaatgacagcgccaatgtggcagccatctttgtaca

SEQ ID NO: 292 - DNA, 10000 bp, Homo sapien
agttctctgctgacggatttggaggctgttcccagtcttttgccacggtaagtagtggtacaaaaaattctcaaatcttggatcttatctcatagcttttactgttacaaatatctcctatctttgcatctttttgccagcatatgtttgggatggactcacaggactgtgatttgtgactgtggggttttaattttgctacatattgccaaattcctctcctttagggctgtaccactttgcattcccaccaacaattatgagagtacctgttcctcctgtggctacttttaagggtaaacttcaaactcctatagatgggagatggtgacttacaaaccgatggcagaaaaaaaagggttccaacaatctacttcattcacttactcatttaataaacatttgttgagtgtttaacatatgcccttactctggttaagagtgataacggggctcagaatctggaggggttacaaagggaacataggcacttacatcaccttatggtaagtgctgatggggaagcattggctgctccgggagcatgtagtggggcaggagtgtctaactgattacaggggtaggtgttcaggaaaggtccctaaaagaagtgacttctaatctgagacttaaaagttagggtttagaattcatctttgtgtgtaattctagagaaaaatggcatgatccatttttctgttttagaaatgtggtaagcaggtggactagagtggggaatgaggcagagagattggttaggatgacacagcagtactctaagcaaggaatgaggatggcctgaaacacagaagtagccaagaaaaaaagaaacaaaggatttgtgagacatttagaaaacagactcaatgggagttgtggttgccttgaaggcaggggctgttgtaatgtaaagccaaggcttttccttgatatattcattggcattctgcatcactttcctacataaacagaccagacacataacataccatctgagatttctagttttgctttctttaaaatggaagaacatcttgaatacacctgtaaaacaatcttcactacagaatctttttagatttctataaatttttctcctaggcttttaccattaacttgttcataattaactcaataacaatttgtcttagctactcatcttcaacaagtgtttctgattttcaacttagttttcatagcaatagcaaccctcttttttggtactcatatttcatttttcgtattatttcattaaattacgtagttgcaactgtaagcataagtgccatacacacatttaaaaaattgttttcattctttttttttttcctttttttacagagacaagatatcactatgtggcccaggctggtctcgaacccctgggcttaagcaatcctgcctcggcctcccaaagtgttaggattacaggcatgagccactgcgcccagcccacagacacatgatgtttagaaaaaaacacaatggaccctcactaagcacacaactcaaatggaggaggagaagcgcaggcatgcaagagacaagcctatgagtcataaccactcattatgctgtgggcaaatgtcagtgtgtttctcctcacaggctctctccccagagaccccttccctgatcatctgtttaagattaaccctttcgaccgggtgtggtggctcatgcctgtaatcccagcactttagggggccaaagcgggaaggatcacttgaggtcaggagtttgagaccagcctggccaacatggtgaaaccccatctctactaaaaacacaaaaattagctgggtgtggtggcaggcgcctataatcccagctactcaggaggctgaggcaggagaatcgcttgaacccaggaggcagaggttgcagtgagcccgagatcgggccactgcactttagcctgggtgacagagctagtgggactcctcctctgtctcaaaacaaacaaacaaacaaagattaaccctttcatcactctctattcccagattaattttgcttcacaggatttaccaccacctgatttttttctgtttcacttgtttatcgtctgtctcttcactaaaatgtaaacttcccaagtagagggatttagttttgtttattccgtgtacctagagcagttcctggcacatagcagacacccaataagtatttgttaaatgaatactgtggaatgagttttttacacatgaaattctcagctaatcaaacaaaatagctatgtggagactgctcaagaagcaatgctgccaggagcggtggctcacgcctgtaatcccagcactttggaaggctgatgcaggcagatcatgaggtcaagagttcgagaccagcctggccaacatggtgaaacctcatctctactaagaatacaaaaatagccaggtgtggtggtgcgtgcctgtaatcccagctactcaggaggctgaggcgggagaatcacttgaacccaggaggcggaagttgcagtgagccaagatcacaccactacactccagcctggcgacagagctagactccgtctcaaaaaaaaaaaaaaaaaaggaaaagtacttccttcaattagtcattctaaagacttcatgaattaaactccataaaagacaacagtgtctagcatatataaaatgctaaataaatgtacgtttattatgatgaatatgttgaatatttacaggtggttaactataaacacctctagttgaaaatatatataatatatattacatatattatatataatatatatgtatattatatatgtaatatatacatacacattatatataatatatacgtatatatattatataatacgtaatatataatacttatatatataattcgcctcccaggttcaagcaattctcctgcctcagcctcccaagtaactgggattacaggcatgtgccaccacgctcggctatatatttttttaattattattttttagtagagacgggggtttctccatgattgtcaggctagtttcgaactcccgacctcaggtgatccgcccgcctcggcctcccaaagagctgttttaaagcacaggttcccatggcatcgcttcttcccccaaccctcacacactgtccctaaccaaagagactgcacaccccagaatgcaacacgcgcctccgcgaagaagacctactcatagcaagtacttcacagcctacaattcccaagatgcaacgcgacctccttcccacagcaacgaaagactgcgactccccggactatcaggccgggagagtccacttccagctcacctcggagctccgggagcctttcagcacctgcttggtgagcgcgattacgtcagtaccacaggtggtcaccttctccgtgagaagccccttcacggactgaccgaaccgcgcttgagactctggcgttccagtcgccatcatttcagttagcgaacggttgcgcactgacgatggtgagtcgccggggccaaaagacaagcaaagcggaaggaaaagaggcgtctcttcctccatgggaaaaggaagggacgcatgcgcctgatggaggttgacctttgctcactaaactcatgaactattcattgatatcctgaggaaaacagggtccaggcaaacatctctggaggggatggaggacagtttcattgactctatggttcagaatcggaaagcctgcggcagggcatggcggcgcacgcctgaaatcccagccctttgggagacccaggcaggaggatcacctgagcctgagagttccagaccaccctgggcaacatagcgaaactccatctctttaaaaataaaataaaattaaaattaatacaaataattaaaaagaatcagaaggcccggattacagtcccaatgctaccatttagcagtgtgtggctgcaaattactcagcttctgtcttatattcctcatctgttaaacagaagtaataatgtttccaaggggttatgagaatatcattccattcatatatatatacacatatatatatatacacatatatatacacatatatacacatatatacatatatatacatatatatacacatatatatatacatatatatttttttttccccagagtcttgctctgtcgcctaggcctttttttgattaattgagacaaggggccaggcgtggtggctcacgcctgtaatcccaacactttgaaaggccaaggtggatcacttgaggtcaggagttcaaggccaacctatccatatggtgacacacctgtagtcccagcactttgggaggccgaggcagaagggtcactcaaggccaggagttcagtatcagcagcctgggcaacatagcgataacttgtctcattttatttaattttattttattttattttttttttgagatggagtctcgctttgttgcccaggctggagtgcagtggctcgatctcagctcactgcaacatccgcctcctgagttcaagtgattctcctgcctcagcctcccaagtagctgggattacaggtgcttgccaccaggcccggctaatttttgtatttttagtagagatagggtttcaccatgttggccaggctggtctcaaattcctgacatctaatgatccaccagccttggccttccaaaatggtgggattacaggcgtgagccactgcacctggcctcattccattcaattttaacaaacatttcatgaactaaataccagacactgtactaggctggggatagagaaagaaatgaaatacagttcttgtctctgtggaactcccaggctgatgaggcagataggcctgtaaacaaatgaagaaggaaaaacaatctaatagaaaaattggcaaaaggcacaagtaggcaattcaaaaaaaaaaatcaactggctgataaatgtgaaaaatgctcaacatcactagtaatttttattgataacctctttattgtattaataccaaactgatggtaaccaccttgtaagtgaattaatatgtaaaatatttcaagtaggccaggtgccgtggctcacgcctgtaatcccagcactttgggaagttgaggcgggaggatcacctgaggtcaggagttcgagaccagcctgcccaacatggtggaaccccgtctctactaaaaatacaaaaattagccgggcgtggtggtgggcacctgtagtcccagctactctggaggctgaggcaggagaatttcttgaacccgggaggcagaggttgcagtgagccgagatcatgccactgtattccagcctaggcgacagagtgagactctgtctcaaaaaaaaaataaaatatttcaagtagctccatttcttttttagttaataaaagatgtgagaatgttattgtattgaaaattttgttcaaaattacctgtattcaatatcaacattacttcctcttccaagtgtctagattcatatgtctccgttgaatctcatttactgtttactttttgtccttaataaactttattgagtttatgtgcatgaatttatgttataatttatgtacaataacaacattattttttgagatggagtcttgctttgtcacccaggctggagtgcagtggcacgatcttggctcactgcaacctttgcctccctggttcaagcgattctcctgcctcagcctcccgagtagctgggattacaggtgcccactatcacgcctggctaatttttgtattgttagtagagatgggtttcaccatgttggctaggctggtcttgaactcctgacctcaggtgatccacctgccttggcctcccaaagtgctgggattacaggcgttgagccaccacgcccggcctgcacaataaccacattctttaaagtgtacgatttgatgagtgtgacagacgtatacatctgtgaaccaccaccactattaagatacagaacagggtgggagcagtagctcatgcctgtattcccagcactttgggaggccgaggcagaaagattgcttgaggccaggagttcaatatcagcagcctgggcaacatagcgataacttgtctcattttatttatttatttttattatttatttactttattttgagacggagtcttgccctgtcacccaggctggagtacacgggtgtgatcttggctcactgcaacctccgcctcccgggttcaagcgattctcctgcctcagcctcccaagtagctgggactacaggtacgcaccatcgcgcccggctaatttttgtatttttagtagaggtggggtttcaccatgttggccaggctggtcttgaactcctgacctcatgatcggcccaccttggcctcccaaagtgctgggattacagacatgagccaccacgcccggccccttgtctcaattaaaaaaaaaaaaaaaaagatgcaaaacatttcatcaccctcagaagtttccaagtgccctttaaagtccatctctccttctctgtctcacccgggcaaccactgccctgcttttgggaactatagattaatttgcatttctagaatggcaaataaatagcatcatacaggcttttttgaggggaggggggtctttttttgtctggcttcattcttgcagcatgatgatttgacatgttgttgtgcatataactagcctgttcatttttattgctgagaaatattccactgcatggatagttctcactgtgtttattcactctcttgttgatggacacttgggttgtttccacttttgggtttttgttttgttttgttgttttttggttttggtttttgtcgttgtttttgagacagagtcactcctctgtcatccaggctggagtgtatggcataaccacagctcaagctcccaggctcaagcaatcctcccacctcaacctccggaatagctggaactacaggttcatgccaccatgcctggctaatttttacaattttttctgtaaagacagggtctccctatgttgcctgggctcaagtgattttcctgccttgccctcccaaagttctgggattacaggcataagcccatcacacctggcctccacttttggaatattatgaatattctgctatgaacatttgtacacaagtctttatgtgggttgttttcatttctcttgggtaactatctagtagtggaatggctggatcatatggtaagtgtttcagttttcaagaaactgccaaaccattttccaaagtggtttaacactttacatttccgatagcagtgtatgccactccagttgctccacatccacaaacttaggaaaagatggaatgttctatagccatggtaacacgtagctacctgtggtggacagactggccgctcagggtagcctttgaccccacctcctggtgttcttgctcttgtgtgatcctcttctcttccttgtggacatgatctttgatttgcttctaatcgatagtgtatgcacaggtgataggaaacacatgatgatgttacataagattacatgttacatcaccattcccctcatcttgctggagcctctctcttgccagagcctctctctcttgccggctgtgagtaagcgagtggccacgttggagaactccacgtgacaaggaactgcaagtaccatctagtcacctacctctgggcctccagctgacagccagcggaaaaaaaaaaaaaaagctctcagtccaacaatcaaaaggaactcaatcctgctaacaaccaggcacataggaagcagattcttccccagtagagcctccagatggaacccaaccctggcccacacctttactgcagcctgtgagacgctaagtagatggcccagagaagctatacttaggttcctaacccaccaagactgtaagataatacatgtgtgttgttttaagccacaaagtttctggtaatattcatggtaatgtggtagtagaaaactaatatattaccagaactcatttgaaatctgttcagctgggcgcagtggctcacactggtaatcccagcactttgggaggccaagtagggaggatcacttgagctcaggaattcaagaccagcctggggatcatggtgaaaccccatccctatgaaaaattcaaacattagctgagcgtgaagatgtgcgcctgtagtcccagctacttgggaggctgaggtgggaggatcacctgaacccaggaagtcgaggctgaagtgagccgtgattgcaccactgcactcagactaagtgacagaaccagaccctgtctcaaaaaaaaaaaaaagaaaagaaacagaaaaagaaatctgttcaatcaatttatgacaactcacctcagtgaacccccttttgcaaaccaaacaatcaggatctgccccttcacttctgaatatcaatcattcaggagtttgagtcctgcctgggcaacatagaaagacattgtcaaaagaggctgggcgcaatggctcacacctgcaatcccaggcagaggtgggtggattgcctgagatcaggagcttgagaccagcctggccaacatggtgaaaccccgtctctactaaaaatacaaaaattagccaggcatggtggcacgcatctgtagttccagctacacaggagggtgaggcaggagaatcgctcgaacccgggaggcggacgttgaagtgagccaagatcgcgccattccactccaacctgggtaacagagtgagactccatctaaaaataaaaaaataagacggacattgtcaaaagtgagagaagaaagagaaataataataggaaagttatagaaaaatattcatgccaaaaatacagcctcatttaggttaaaaaatacagtttaaaaatatttagttttagtaatttgtgttttccaaatttctgcaattatgatgtataacttttataatatggtgatgagagtgtgaagcaacacattttgtgtgtgtgtgtgttttaaattcccatttcttgtttctgattggggtgaaatatcaggtcagcttggcagtctctgtaggagtagaaagtagccattcatatttccctaccagctggttgacccgactgaggcccctgcctggatcttaggattcaggcctctccacttgtcagtccagctctcaggctttacacacgatctcctcatccagcctaccccatgcaccaacaccagtttcaccctcctaaaacaccactgtcaccttgctgctccctgctgcagtgctctcaatagctcctacagcctccctataccctttatacccttccattccagggctccagagcctgacacaatgtacccctcagatctttctcagggatcccccacaacacacctctttgtctcttcagctaaggccatcaccattcccctcctgccatgctccttccagcctctgctactctcccttccagcaacacccttctctccctactccttcacatctctacctaacagttctgaggtaggaggtaggactggactcaggaaggtgaaccttactctggaggcagggctcagacacctgaccaaattgaggaccagttaaacagatctagggcaggccgggcacagtggctcacacctgtaatcctagcactttgggaggctgatgcaggcagattgcctgagctcaggagttcaagatcaccctagtcaacatggtgaaaccccatctctactaaaatacaaaaattagccagtgtggtggtgggtgcctgtagtcccacctgcttgggaggccgaggcatgagaatcgcttgcacatgggaggtggaggttgcagtgagccaacaaagtgaggttccatctcaaaaaaaaacaaaacaaaacaaaacaaaaaaccaggtccagggcagaagcagctttccataagacccacccaccagtgtgccatgtcactttaccattgccttggcaacacccggatattaacacccctttccatggcaataacttgatggcctgaaaattactacctcatcctagaaatttctacataaaccaccccttaattt

SEQ ID NO: 293 - DNA, 10000 bp, Homo sapien
agagggagtcaacacaggtttaatgtaataagtggggagtccatgttgaccttggggagaacaacgtcagctctgaggactagagccagagtgttaaggagcatgcaagaggtgggaagtggagaaggagtataggcaactctttcagaagtttggccatgaacagaagtttttaaaatgaagatgaggagagggagaagatagcgtaagaatagaagaacatgaacctggaagctgctaactgagcgggtgcaaagggagttttagccccaaaagattaaaggaatgttaagtgagaagtcagtgatgttggagggcttgggtgccctgttctatggatccaaaggattctaagagagaggaagaaaggcacagaggagggtcaggggagagagtacctagagatgttggagggaaagggcaattaagaagatatatgacagcctatctcctttgcaggaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacaggtacacctctttaatggagtgaggaaaacttcaaattctggggcacagcctgccacattcttctttgctttctgcatactccccagctcctgtgccaggtggtcagactgaagggagaaaagattcatgtgtaattattcgtgaagtattgattgtctactatgtagggaaacagccatgaatgagcaataatttccctagaactcatattctagttggggaccataaatcagaattttagagaactataagtaataaggactatgaaaaaccaggttccaagcaaaagaggaacaggaagactattttcaattggccttttccctcaaggtgaatgagatgccaggtaggaccgagactctgagagaaggcacagtgatgaagggtagagtgggaggatgaagtcaggccaagcaagggcccactcacacagggcctcggaggccagtcaggagctaaaacaaagcccaaagtgaggacatttcagtgagaaagtcacagaagggctttcatcaggggattgatccaatctgacttagatctttaaagaatcaacctggtggttgtgttaacaaacgggctgggtgtggtggctcacacctataatcccagcactttgggaggctgaggtgggtggatcacctaaggtcaggagtttgagaccagcctggccaatgtggtgaaaccccgtctctactaaaaatacaaaaaaattagccaggcgtggtggcaggtgcctgtaatcccagctactcaggaggctgaggcaggagaatcacttgacgggaggccgaggcaggagaatcacttgacgggaggccgaggcaggagaatcacttcaacccgggaggtggaggttgcagtgagccgagatcacaccactgcactccagcctgggcagcagagcaacactctgtctcaaaagaacaggaagatggagcagggatctggtctgatgtaatccaggcaagagatgacaacagcagtgggagtggtgaaaaaggatcagtttcttgacatattttaaacatgaagcctgaaagactttctgatagattctttctgacagattgaatataaggcttgaggtaaaaaggatttaagttgtcttttaacttaagcaactatagaagggtgataccatttacaatgtgtggtaggctaaataatagcccccaagatgtctacatcctaatccacagaacctgtggatgtcgccttatatagcaaaagggactttgcagatgtgtttcaattaaggatttttaaatgagattatcctggattacctggatgggccctaaatgcaatcacaaatgtccttataagagggaggcaaagaaaaatttgactgcaaagatgaaaaaggcaatgtgagaactgaaacaagatgctgaattgctgtctttgaagatgggatgaaggggccagaagccaagggatacaagaaatgcagctctggagactggaaaaaggcatggaaccatactctcccctagaacctctagaaggagtgctggtttcaattgattttggctttctggtctccagaactgtaagagaataaatgtgttgttttaagccatcaaatctctaataattggttactacagcaatatgaaactaatgcactacaagagaagagacttcaggcaaggcagggagcagattggggggtgatttaagtttaaaatactgttagaagagaagagacttcgggcaaggcagggagcagattggggggtgatttaagtttaaaatactgttagatgtgtaagtagagaagtcaagtaagcagttagataaacaggtctggagtcaaaggagaggcctaagctagagatatcgatttgggtatcgtcaccatatgaactgtattaatccaggaaactggatgaaattaccaagaggtggtatagacagagaagaggtcaagattggagtcctgaagcactccaacatttaaagatcagtaaggagagaagaaaccaataaaggagaccaaggaggaataacctgaaagataggaaaaaattaggataaagagagatattcttgaagctaaaagaagagtgtgtttcaagggagttgtgctgtgatgagcatgtgtatgttatgaagactgaggactgaccattggatttggtacaatagagtcatggatcaccttggcaggaacagataggataatggtggaatgcaagcctgctggagtggattcaagttagaatcgtaggtgaggaaatggagatggtgaatacaggcaatcatatggaagggttttgctgtaaaggtgagtaaatgtaaagaaatgaggcaatgcctggaagggaatgacaaaagaactttttaaagtaggtgacattacagcactatatgctactgagaataactactcccacaattcttctctttctctcctgcatcctcatcctgcattgactctaggcaggagtcaatgaaatccaaagcacacaagtggagatctagccccagataaaatcacatcctttcattataacaggaggaagtggaatatcttacatccaggcacaagtacaataggtgatgcaatgggtggtagttagatgaacttctttttgagttgttttttctcagtcaagcctggaggtttgaagagagaggtaaaagttcaacatgagactgaactggccaggcaaatctgataggactgctgggcaacaatgagggcccacttaagaattgtgggtataaatttaaagtgagaccagagttggatctcttcaacaatgctcagtttccccagtaaaggcttgttatatgaagaaagttggaaatagccagggtcgtgtttctcttggcaaatacaatgggacatgttccaactgcctctttgttattgattcccctggccagagaacatactctgaataatatcgatcctttgagatttattgaagcttgttttatgactgagtttatgaccaattttggtaaatgttccatgtgtactttaaaagaatgtgcattctgatgttagatactgtattctatatatgtgtcaattatgtctacttggttcattgtattgttcagatctatccttggtgattttcttgtctgcttagtccatcagctgcagagaggtgtgttaacatcttccactatatttcgcaaagttctactcatttttgctttaaaattatatcattttccttttattcttacaaaatatccctctttatctctggtaatgctgcttgcctgaaaatctattgtctaacactagtatagctaaatcagatttattttaattcgttttctcatggtataattgttccctccttttaactttcaacctttctatgtcattatatttaaggtcctcttttataaagccacgtgtagttgggtttttatctaatttaatcatcttagtcttttacttggagtatttgatacatttatgtttaacataattaattatatagttgatttttatctactatgttacttttgttatttgacctacctgtttatgttgcttttttctcctttttgctttcttgtggatttgccaaacattttaattattctgttgttgacgatgcactcttttatgttgttaacataatagtgattataacatgcatcattgcatcaatacagtctcatacaaattgttacttaatatccccaataatgctagaaccataaaacacttcaactccttcaaccctcctcccccttacttttgcattgttgtggtaatgaattttatctgtatatgtaatttaaccccacaggacattaatttatattcacccacacatttgccattaattcctgaatagttctaacaccaactttgcttgaagatctgttggaaacagattctcacagtttttcttttcaaatatctttactttactttgtatttctcaggccaggcacggtggctcatgcctgtaatcccagcactctgggaggccagggcaggtggatcacctgaggtcaggagttcgagaccagtctgaccaacatggtgaagccctgtctgtactaaaaatacaaaaattagctgggcgtggtggtgcaggcctataatcccagctacttgggaggctgaaacaggagaatcacttgaacctgggaggcagagattgcagtgagccaagattgcaccagcctgggtgacaaagggagactccgtctcaaaaaaaaaaaaaaaaatctttactttctattcttcactgagtatagaattctatgttagcgattcttttctttcagcattttaaggtatcatttcattatcttcagttatttttgctgatagtcttattgttgctattttgaaggtgctgtatcatttttctctactttccagatttttctccgtgatctttagcagtttattatgtgtgtgcatatggcattctttgtattatgatttgggatttacaaagaatatgtgtatttcttgaatatgtatactgatatctttcaaaagattgaaaaaaaatgtcagccactattttttcatatattctgctgcctcgttctctctcacctcttctttgggaactctgtttaaaaaaaaaagttaggactttccattctttccattgggtctcacatgtctctttctgcttcaatttggatatgttctatcaacctatcttctgtttctaataaaccttttaatggcaaacactctatatagaagattacactttcctctgctaggcaaagagagtagagactgagttgaagcttctgtagggctcagcctgcctctgatttgcccctaatcctggggcttgtttgccaggatcagatctcttggctgccatagccttgctgctcagcacattgagactgtgaaaaattctgtcctcaatttaaatgatttttggcttaagttctctggactcctgctccataccaccttagaataagagtatgaaatccaatgggagaaggttaagcagaaaggagagagaacagctaaagtccaaacttgagggaagtttaacaggatagctggaggagaatgtgttgtcaagatggtatcattactgatgggttaggaagctctcagtagaggaagacagtgtcaggtgctaaagcctttggtgaatgaagagaaactggcaggaacaaatacaggtagctggaggctacaaaggcctcggggtatgtaaagtctagaaaataaaaagcagcctctacttaaggctcaggggacaagagtttttaattaaagcaagagagtaattaaagcaagagagtaaagggagacttcaaagatggtgatgagtggagaagagatatatttcagcagggtgggaaaaatcaagagttcaattctctatacgttaggttgagatcatcaacagatgaatgaattctagagtcatcagagtatagagggttattagaagccatggcattccagtgaaagagagaagacagtcaaagatgaagtcagaatgaagaggagaagccagggaggcgggaggccacgtgaggtaaggaagggtatgtaagggtttaatcatgtggaatcttactgaaatgtcaaataggattacagaatggtctctgaattcggcacgaattcagaaacttggtgaaagtgagttaaggagaaatgcttacttctttagaaaagttttgaccagtggaggcagagatgatgcagtttttctccccctcatcggagagactagaatactagaatatgagtgggtgaaataaaacaaagtataaggtggctgaggtggggaggaggaaaagatcattgaaaccaagaaggaactaagaaaaggagggctttggatgactcttccatgtggattgaaggcaccaaacttagtgaccaagtgagtagtagagaggaagacagcaaagggaggactagaatgttgaccagtgacaagaagaagagcagggggccatagtctagtggcatgagcattatagaacagagtttttgagcttgtaatctataagaagtagaaaacagctttcatttgacagggccataggagaagctatatcatcaggggatagcagtactgcagttaaaaaagagcacgtctgctgatgccatagtctgagacccagaggcgccagtcaaaggctgtgcaagatagaaactgcccagagtagaacaaagatagatagagaggggtgataatggatgatctcaaagtccacctcagatgacctaggaggaaggaccaactcaccagaatctaggccacagagtagtctagggaaggatgctgagggtccaagactttcaggaagaacgaaggaaccctggagctggttcctgagtgaaaaacttagcctctgtgttcagacttttgccatgttggtctaggtccctttaagtaacatgcaggaaaataaggaacattattgaccactaattttatgcctctgggccgggcacagtggctcacacctgtaatcccagcactttgggaggctgaggtgggcggatcacctgaggtcgggagtttgagaccagcctgaccgacatggagaaatcccatctctactaaaaatacaaagttagcagggcgtggtgtgtatgcctgtaatcccagctactcgggaggctgaggcaggagaatctcttgagcctgggaggcggaggttgcagtgagccgagatcacatcattgcactccagcctgggcaacaagagcaagactccgtctcaaaaattaataataataataataataataataataatgcctctgagaaaaaagacagaggggaagcttctgccctgggttcccaaatggaaccattggcaaggcttctagactggctttcccctcgcccaggagtgatgcccatgcatacaacgcccagaaatgaccatcatgtcagctttcacaacatgtcactattttttttcaagtccataggtgtggaccctctgccggctaagctgtcctatgacaagtcacatgaccaagtgtgggtcctgagctggggggacgtgcacaagtcccgaccaagtctccaggtatgttgagcacatggaggctgatacccacactccactgagagaagaactctctccctataaaataagtatctcctgcttccccgggtagctaattacatttatccaaaatatatccataaaggctcaaggagagagtaggaaacagcctcaggccaatgcccctcacaggcaattgatgacagcaataatgatgatgaataggattctgacatcacaacaatcagaatgtggcacccaatccccatccagccccacaatcctgcctctcttgagccaatagctcctgggtcccaacagaatgaggctctggggtccagaagggaggctgaagaatagtgtcaaagcaagcagcagatgttagccaatgaagaaggagaagcagcagcaattatatctgtaaacaaaagcccacttaccaagtgcttacagtgtgctaggttacagaaaatttccataatttgcctatagtccaccctagacagtgtggctctggagcccaaacatctagcactcccttgggtagagcttgggctccagagatccgtgggatcccttcccccatcagccaagaaaggtcaatagcaaccctgacttgagcaatttgagtatgccctgcccagccttgcccatcagggatccataagaggaatgagccctgtaaagtgatttgaatgcccattttctcaattctcccaaagatggtgcaaagaaccattctgggtgcacaggagaaaagttaattcattacatataatggatgcctctggagattagggtctctctctctctctctcagaacccaaggtgagaagggctgcaaatggagctaactcccctgtagaaccctctggaaccaagactggcaagagggcagaaagaccagggtctggagaagcttccttctagggactgaccacctacctgcacctctgcatcactcacaacttcagtttctatactctgaggccactgtcacactggggaagccaccaaccattcttgggtccagtgaggtgacaaaaaatagtaataacctatcagagagcctggacaccacaataaaggccactcagaacagagtaccagcccaaagaaatacagctgccagaaataccaacaaaaaataagaaagcacttcagaaaattcaagaggaggggccactagaaaaagaacaaaaaagatttcccagtttaaaactgcaatagatgaaaaatgtgaacaggcacagtggctcacgcctgtaatcccagcactttgggaggccaaggtgggcagatcacctgaggtcaggcatttgaaaccagcctggccaacatagtgaaaccccgtctctactaaaaataccaaacttagccagacgtgatggtgcacagctgtagtcccagctactcaggagcaaggagaatcgcctgaaccctggaggcagaggttgtagtgagccacgatggaaccactgcactccagcctgggcagcagagcaagactctgtctcaaaaaacaaaaaaagaaaaatgcatggtttctactgagacccaaaatagtagtctgaaagataaagaacaagaaaagctctctcaaatcacagagcaaacccatgaagaggttgagccgtgaagtgggaagaacagaagtttagaaagaaaagataactattagaacggagtcaaacattaaataagtttccaataaaatattcaagttgaagaaacttaatcctgtagattaaaaggaatctacaagtccaggctaaactgatgagaaatgacacatctcttcactagtgataaagttccagcactccaagttttaagaaaaactaatcaaattgacagtggacttctcacctgcaataggagctggaagaccgtggtatcccatctacacgctccaagggttctattcccaagcaagacatcatttacctgtcaggacaaaagaaagatatacgggtacgcaggaactcagggagcccatcactcatgggccacacctaaggaaagatactagacaaacatcagatgagccagattagagacatcaaggtggacagagatagtggcaagtaatgaaccaggagaggaagatctaaaattaaaagtaaaatggatgaggagaggctatctagaaatgtacaataagtgccaggtgaggacatttgaatgaggagagagacaatgaaagaaattctgataccaagctgtaactaaagataaattgtttcagtaaaaagagtaggagccaggtgcagtggctcttacctgcaatcctagcactttgggaggctgaggcaggaggattacttgagctcaggagtcggagaccagcaggagcaacctaggaaaaccgcatctc

SEQ ID NO: 294 - DNA, 10000 bp, Homo sapien
taggtggtgcccaagtagggactctgtgtgggggctttcaccccacatttcccttcctcactgaccagcagaggttcttcatgagggccaagctgctgaagcaaacttctgcccgggcatctaggcatttccatacatcctttgaaatctagatggagttttccaaaccatagttcttgacttttgtgcacccacaggctcaacatcatgtggaagctgccaagccttgaggcttgcaccctctgaagccacagcctaaactctacgttgggccctttcagccatggctggagcagctgggatgcagggcaccaagtccctagactacacacagcaccaggaccctggacccggcctatgaaactctattttccttctagacctctaggcctgtgatgggatgggctgccgcaaagaaagatctctgacatgccctggagacattttccacattgtcttggggattaacattcagctgctcgtttcttatgcaaatttctgcagcgggcttgaatttctcctcagaaaatgggattttcttttctattgcattgtcaggctgcacatcttccaaacttttatgctatgcttcccttataaaactgaatgcttttaacagcacccaaatcacttcttgaacgctttgctacttagaaatttttttctgccggatatcctaaatcatctctctcaagttcaaagttccaaaatctctagaacggggacaaaatgtcaccagtctctttactaaaacttaacaagagtcacctttgctccagttcccaataagttcctcatctccatctgagaccacctcagtctggatttcattgtccatatcattgtcagcattttggccaaagcctttctacaagtctctagggagttccaaacttttccacatttccctgccttcttctgagccctccaaactgttccagcctctgccagttacccagtcccaaagctgcttccacattttcaggtatcttttctgcagccccactctactggtaccaatttactgtattagttccttttcatgctgctaataaagacatgcctgagactgggcaatttacagaagaaagaggtttaattggacttacagttccgtgtggctggggaagcctcacaatcatggtggaaggcaaggaagagcatgtcttccatggatggcagcaggcaaaaagagaaatgaacttgtggaggggaactcttctttataaaaccatcagatcttgtgagacttattcactatcatgagaacagcatggaaaaaaacttacctccatgattcaattgcctcccactgggtccttcccacaacatgggggaattcaagatgagatttgggtggggaaccagccaagccatatcaagtatcctcggtataaaagagaagcaagcaggaggtatcaaggtagatgaagtgaaaggagaaaagattaggaccttcacatcctgggaagagagtggttacagtggaaaatcatggagtctaggtatctgggaaggaaaacgaagccaggagagagacaaacagctgtgaggagaggatgagctgtactgggagcaagtgagtaagagccagaagaaaaagacctgtggctcaagattggtccatcagagcctgtgtttgttcttatggctgctctaccaaatgaccatcaacttagcagcttgcagcaaacatgtttattctcttacatttctgaaagtcaggagtctaagatggattgagagggcttgttcctgttggaggctctaagggaaaatctcttttttgtcctttccagcttctacaggctgcctgtgatctttggcttatggcaccacatgctccaacctctgcttctgtggtcacatctctttctcccaccttgaccctcctgccttttttttttttttttgatggagtctctctctgtcaccaggctggagtgcagtggggcgatctcggctcactgcaacctccacctcctgggttcaagtgattctcctgcctcagcctcccaagtagctgggattacaggcgtgtgccaccacacccagctaatttttgcatttttagtagagatggggtttcaccatgttggccaggatggtctgccttcttcttaaaatggccctgtgattactttgagcctccgcagttatctaggagaaacttcccatctcaagacccttaacttagtcttatcttttgtttcttttaccaagtaaaacaacatacccacaggttctgggggtccagatgtgaacatattttggtggaagggggcattatgtgacctactacagaggctacatgcctaaagatgaaaatgtttttgtggtaataaagtctgggtgtggccagatgagtttctgaaatagggtctggataacctagggctagggttgaaggagacattttgagtctatgttttggagaaggatgatctacatggtcaaggaagtcactaatgttagggtagagaggactaggatcttggtacaaatgttctcagtaagtgagaagaatgaccaggaagttggaaggtgatgtaatacgaggagtgatatggtttggctctgtgtccccacccaaatctcatgtagcactgtgatcctgagttttggaggtggggcctggtgggaggtgattggatcatgggggtggtttctaatgagttagcaccgtcaccctagcgctgtttcgtgatagagttctcgtgggatctggttgtttaaaagtgtgtagtgcctccccctttactctctctctcctgctgtcttatgaagatatgcttccttcccctttgccttctgccatgattttaagttccctgaggcctccccagccatgccgaactgtgagtcaattaaatctcttttcttcttaaattacccagtctaaggtagttctttatagcaatatgagaacagagtaatacaaggagtaaagaaagtatggtgataccaaaagaaaagaaggaaattgtgtgtaatttgggaaagaatcatctaaaagcatccatgaagaactaggatattggcaggagcatctccacatcctgccttaggcgcggtgatggagcaaaatagccaccagagggcagcagaaagtatggcatcttaaggagaaactgcatcttacttattcatttgtcagtcccatgtctatccattcaccccacgaggattaagccagatattgggaattcaaacatggtctttatatagtttatcttcttaaagaattcacagtctaatgcaagagatggatattgacacaatgtaaaaagtgctataatcaaaatatgtcaaaatatgggaaggcagaaaattaggaacagttgcacagaagagatgacttttgagctggccttaaagggtgggttgaatttcccataaagacaagagtaacaggcccggcgcggtggctcacgcctgtaatcccagcactttgggaggccgaggcgggtggatcaccaagtcaagagatcgagaccatcctggccaacatggtgaaaccccgtctctactaaaaatacaaaaattagctgggtgtggtggcgcgcctgtagtcccagctactcgggaagctgaggcaggagaattgcttgaacctgggaggcagaagttgcagtgagctgagatcgtgccactgcactccagcatagcgacagagtgagagtccgtctcaaacataaataaataaataaataaataataaaaaaaggttaaaaaaaaaagacaagagtaacaggtcgtactaggaataagggagacatgagaaatactgagtaagctcccatacttgtttgctacggctcagaacaaactactacatgctgggtggtttaaacaacagaaatttatttctcacagttctggaggctggaagtctaagatcaaggtgttggcagatttggtttctcctgaggcctcccttcttgcctagcagaaggccacctcttcagcgtcttccctctgtgcacacgcatccctggtgactcttcctcttcttatagggatacagtcatattcgattagggctcacccataagaccttatttaatcctaattacctctttacatgcctatctccaaatagagccacattctgaggtatactgagggctatggcttcaacatatgagttttgaagggacagggttcagttcatactacctcttttctatctgtgggttatgtgaatggtcatattttgattatgaggatactaaaaaggaagataataatcttgatagttcccaatattttttttcatttcattcaaaagtggaaacagcactgaactacaagttaaggagatccaggcttaacttcctcatctggctgcatacaatactaaatgctcgaatagcccttccctctgcagaacaaccagacactgaataggaaacagttattgatgagttaatgggctcaaatgaggacacaaaataggtgagaagtccaaggtacactatcccatcccactctaaaaacaaaactattaaataagagcaaaacgaaacagaaaacaactctgagatgaggatagaactgtcagtggagagcagatgaaaggagcagggtggccccagggacagacgtccttatcagatctgtaattcaggttctgagccttgttccagcaggaggaggtgaaactgagcccctgactccacttggagccacaatccttgaagaggtttgaagaagttccaggtcagtggcatttccaagcttctggaagacacaaaagaaatccattctggaagaaaatattctcatggtaagaccatgaaataagcacacatttaatatagagtactatgaactctaaatccaagaccatcaattatgagaaggaaggctaacatgagtgagaatcagaaaaaataaacaacagattgagaacacaaggactgtggatatgaatattgtctgctgcttaagatagaagatccatgtatgagctcaaaatgaatgaaatacaagtatgttctaacaataacagattgtcaaagatgcccatacagtttcaaaacatagccaaatgaaacttttataaatgaaaaataggactactgaaataaaatacttaatgtatgtgttaaatagttgattatatatagccaaagaaaaaattaatgacctacagtatttgttgaaagaaattatttaggctatagcatagagaactagggaactgaatatatgaaagaaaaatgaagagaaatgaatgctaaaataaaaattctaatatttatatgatcaagagttccaggaagataataaagagaatggaggaggataaaaatttatagagattttggcagatagtgttctaaaactggatgaaaacgtagattcaggaagcatcaataatataaagtagatcaaaaggccaaaagtttattgttttaaaagaccagtaaaaaagaaaaaaatttaagtaaattgattgagaatgaaaaagagataaatagtaaataatatggagcctgataaaggagacataattatgtatgcagtagaattaaaggaataacttaatgacggcaaatttaaactctaaaacaaaatggaaaaagttttagaaaaatataaattacaaaataatctaagaagaaataggatgtttgaataaatctacgcctattgagaaattaagtaacattttaaggtttctctcaaagcaaataccagataattttataggccaattctcccaacctattccaaatagaataggtcattccaaatttatataatcttatataaactccttaagatttcttaaaagtacatactttgcaactcacgaatatagtgtaaccttgaaatcaagactagacaagacagagaaagaaagaaaatgtatgggttaacctctctcatcaacttttaaatgtaaacatttctttcttttttcttttcttttctttttttctttttttttttgaaacagaatcttactctgtcacctaggctgtattgcggtggcgcgatctcagctcgctgctgcctcctcatcctcctaggctcaagggatcctcccaccccaacctcctcagtagctggggctacaggcacaaaccaccatgtccagggactaatttttaaatttttttgtagagatgaaggggatctcgccatgttgtccaggctggcctcaaactcctggcctcaaacgattctcccacctcagcctccggaagtgctgggattacatgtgtgagccaccacatccagctagatgcgaacatttcttaaacaaaatattagccaactaaatccagcagggtacttaggtgaaaccccgtctctactaaaaatacaaaaaattagccgggcgcggtggcgggcgcctgtagtcccagctactcgggaggccgaggcaggagaatggcgtgaacccgggaggcggagcttgcagggagccgagatcgcgccactgcactccagcctgggagacagaacgagactccgtctcaaaaaaaaaaaaaaaaaaaaaaaaaaagataacacaagggtggtttaacattaaaaactctgtaattggccaggcatggtgactcactccggtaatcccagcactttaggaggccgaggcaggcagatggctttagctcaggagtttgagaccaggctggggaacatggtgaaaccccgtctcaaccaaaaatataaaaattagtcaggtgtggtggctggtgcctgtaatcccaactgcttgggaggctgaggtgggagaatggcttgaacccaggaggcagaggctgcagtgagccgagatcacgccactgcgctccagcctgggcgacagagagagactctctcaaaaaccacaaaacaaaaaaactctgtaatcatcagcccctacattaaatgagaaaatctacacgttgtctcagtagatgtggtagaaacgtttgacaatattcaatattcgttcatgatttcaagtaacaattataggaaggcatttccttacctcaaaatattattctgaatgggaaacatcagaagcgtttccccggttcagttattttcttatatttaaatattttaacagctctattgaagtataattgacataagataaattgcaaatacttaaagtgcacactttgataagttttgacataaatatatgccaatgaaaccatcaccacaataaaggtaactaacacatccatcatcttcaactttcctcctgctctcccagcatcaccctgccccctttcccaagcaaccactgatttgcttcctgtcactttagactagtttgtcttttccagaattttacataaatgaaatcacatataatgtaccttttcgtgtctgacttctctcactcagcatgcataattattttgaggtgcatccacgttgtcgtatgaatcagtagtttatatttttatagctgagtagtattccatagtatggatgtatgataatgagtttattctttacctgttgatgaatattgtctcacttttttgtttttgtttattacaaataaagctggtgtgagcatttctgtgcaagcctttggagatgtcctttcattactcttgggaaaatagaggttaagcattcctaacccaaaaattcaaaatctgaaatactcccaaatccaaaactttcaaagcactgacatgatgccacaagtggaaaattccatatgtgacctcacgtgacaggtcttagtcataacacagtcaaaattttgtttttgtttataattattgaaaatattgtgtaaaattactttaggctatgtgtataaggtgtatatgaaacataaatgaattttgtatttagatttgagtcctactccaaagatttcttattatgtatatgcaaatattcaaacattcaaaaaaattcaaaatccgaagcacttctggtctcaagcattttgaataagggatacttcacctgtacctatcagtaatatgatagggttgtgtgataggcatatgttgaactatttaagaggctgataacctgttttctaaagtaattataccattttatattccctccaggagtatatgagggtcccagttactccacagcctttcacacacttggtatggggctttttttatatggtcttttttattttaaacattctaatatgcaattgtgtttttatttgcattattctaatgaataacaatgctgaacatcttacaatgtgcttattgatacctgtatatatatttttgatgaaatgtgtgttataatcttctgcctgtttttattgaatttttaaaattactactgagttgaaaaagttctttttatattatagatgcaagtgctttaccagtaccttctcccagcctgtggcttgctttacattatcttttgaagaacaaaagttcttaattttgaagaagcccactttttcacgcctcttcccacacctctttgtcaccaactttccaatcatggtccagccaagcccctgaccatctagcctcaccattggccacagcccatgagttggtatataattgcacgactggccactttccttctgggatggttaattttggttgtcaacttgactggatgaaggactatgtagagaactggtaatgcatgatttctgggtgtgtgcatggtggtgttctcagagaagactggcacatgagtcgatgagctgagtggggaaggtcctctctcgatgtgactggtaccatccaatcagctgggggctccaatagaacaaatcggtggtttcttctctctgctagagctggggtgcacttttcttctcctgtccttggacatcagaactccaggctctctggactttgaactctaggacttacaccagcacccctcacctcccaggttctcaggccttcattctgttaggactgagagttacaccatgggctttcctgtgttctgaggttcttggacttggattgaggcatgctctcagagtcccagggtctccagcttgcagatgaattctcatgaaacttctcagtttccataatcacatgagccagttccccaaataaagcccctcacatatatgggtatatatgtaatacgtacatatatatgtgtgaatacatatggattttatcctattcatgtacaatcatgtctggatactttccttctgtgatggttaattttgggtgtcaactctatatatatatcttgttggttccgtctttctggaaaactctgattaatacaccttccaagcaaaatgaacaactacgtgcacagcttgaattctgctccatggaaagatttcccctcaccactattttcaggggtgtctcagaaacgggctctagtactgcagttgtccattctgcatggtgcttgtgtatcaggcagaatcgcctgtaaaccaagcctgagttttctcttcctccatcaactgattatgggtaactccccatgaggccataagtacaggctgggagagagaaggcactgtggcaggagagaaactataggcatttgggccacttcttcatgtaacttacttataccttcaacttcagggtctacttgggcccaattatgtttataccacttcaatttggtaatggagtaccactttgtacacccagctttatggcttgttcatctgccataaagcataaatactcagctcataatgggcaactcagattgcaggtgaacgtggctgagcattcagtctctactaaaaacctgtttcaagccaaaaactgttcctcaaaaggagactcatgtgcatatgatggcagggctttgctttaaaatcccgagtctacactgtgatacacctttaatataaagtcctgagtcaacattgtgatatgccagccaaacactccagataacatctttgtctgacattgactccccaacaaccattggatcggatggatcactgggcctaacttgcagggcagctttcatgtcagtttggacctgtcgcagagccttctcttgttctaggccccactaa

SEQ ID NO: 295 - DNA, 10000 bp, Homo sapien
tttgtgatctctgttcatgtctgaattgtatttgatgagctcactcttcaaagttcttcatctcctcagcctatgcattctctttcacttctcacacaaaaggagttccctataaccagttaatgaagaaggaaaaaaatctgtgtgttatgctggcactgcaggaaagctactgtactatagtctcactcagggctggccctgactgacagcagtgaaggaaaatcctcccagagagcagaagtttggctggaacattgggctgcccaccacatttggaagaaaaagcagccggaattatgaccatacacacatttgtaaacaccccacagcctaatgaattggccaatgacagaaaaatggtgacgagggagactacaggaaagggagggagattttaataatcagaataaggagagacatcctgtaaaccccccagtttcctctctccccaccaactccagtgcttgctcagtgggagcatgcacaaagtggtgatggaagcagaaatgaagagcaccctaacagcatggaattccccttaccaacgctggtctgtttaacaccgttgctgagtattcaacttcccaatgtcagaagttagtgctaggcctccagtacaacaccagtccccataaggtaccagctgaccacctagtagcaggttgtttatatcggacacctttcatgatggaggatgcaacgctttacttaagtccacaaatgataatgccttatcatcaccatagtatcctatacatcacttctgtctagagatcacattttatgtgtgggaattaaggtgatgggctcatgcccatagaattcactaactgtaccatgtatcccataacacagaagtacctggtttgatgaattaatgatatattctgctgaagtctcaattctgttgccatccttcaaaattgggaggcattcctgcagaatgaggtaaatgccttaagccagccccatagccagaatgcacatgtctgggaactacagagtagaggtaggagcgtttcctacctctactattacatcaacacattggaggatgtttttgtctcacctacaaccctgagctccaaagagtcctagtatccaaaagaaaaatgcttttgataaggaatagaagacatggtttctgtgaattggaagctaagactgctgcttgatcaactggaagataagaccgcttccaagaactattgattctcatgccactgagccaataagcaaataagagggtttctgtattacctagtgtattgtattgactccaattataaagaaaaatttggttgctgctgcaaaataaggccaaagaggaccaccagggagtcattggtgcacttcttagtacttttgcccagtagtcctgaaaaccttggcaactaaagaaagagaccctaaaaagtcagatcctacagaaatgaagaagcaaaacaattttccccagcaggtaaagaactctcttcagctgaagtctggcagagagggtagggaacacaaaatgtgtggtggaaaagacgctacaactgtcaaccaaggcctcatgatgagctgcagaagcagagacattagaagctgtgttttatattaatcaatggtttttcttcctgatttctccccattaacttctatgggaaacactgagcgatgggtaatgctttagggtttagttttcagtggagaggagtatttcaacccaggctccttccagtctctgctggtcactgtgttcttctaccaaggccagagctcctgccaagtctacatttctcctgccatgagtccgtctcctggttccaggatctactcctccccgctgaccctttattaggttttccagccactcagccggctagtgtgtcccatctctctcctgctaaggtcctgacacacatagatgccattaacaagtcccccgacatgcaacaggctccttcctttgtatttcaggggggtagaaagggttcttttaaaccatttattacctggtattatataggttactttagaaactttatagaacttatatattctagacaatcatatattttagacctgcctgctccctctgtttacaaaagctcttattaatgtcttcatttctatcacattgctacaaacaaaatttggtccttagtgcttcaaaaagaattacacttaatgagcagccactgtatgcccagcactatgccaggagttttgcacacagtttatcatttaagtgtcacaggaaaggcaaatcccctcttcttgttgcacaggtcaaatattttggagacacccttgacccctcttgtcttccttatacctggcacatagcggacactcgatgaatgctttgaatgaaccaataaacaatgctgtggtgtagatgttacttacatgttgcagaagcagctgagggccattgagaaatttgcctgaggtgacacagctgggaagagcctgagctgagagaccctagccttgctttttgtgtttctaatgtcacgttttcccttggccaggatgctctccagtgtggagctccattttaggctcttgactgctctttctgaccctgccttgggtgttgcaacccactgtgcccattggtgttaaggttctctttcctgaaatcttgtcttgacaaattgttctcctactcaaaaactttcatgccccccgccccttagtctgcctgccagactaagcttaccaccttcagctttgcactggtgccctccacaatcaatttcaattgacccttccaaccgtatttcctaacctttctctagagaatctccattccattgaaatgtgccttttccctggagctctaatccactatgcagttcttttttccctatgtatttgttcaacccatttcctctacccaaaatgccctcctggcaccactatccatccccaatcccttatccctgcctatagaaagccacctgttcttgaaggccaggagcagacatcccatccccctctgaagctctctctgaataatctcagtgccagatcctccagagtgcttaggacagaaagttttacatagtagagggttcaatattttcttataaactacatcatgctctgaaacttaaatgaagtacaactgagatctgggagctaattacacaatcttagtattgtgtatttatttcagaggtaagacatacatgctgtgtggagagcattgtctttgcaattagacagatggaccttcaaatctcatctctattcatgatctttcataaagttggttgatttacttaacctttagaaatttcagttgacttttctgtaaaatggggataatattaccttcttgatagaatttttataatgattagatggggtttttacactaaatgcctgacaccatgattgacacatagaaaatactcagtaagtggattacactggagccatcagaagcaggtgagctattatcatggaatcagaaaatcctatacccacaagcaccccaacagtcatccagtctcagcctgccctgccgctcttcaccagccaccaacagcaggctgataaacaccaaagatgtcaccatgatggttacaagtgccttctaaatgaatttgtggtttggatcacaacaagtaccatgtaattctgactgaaagagatacagactgctagagtgtaaagtggattgtccctaattagaatgagcatgatcagttacccaatcctaaaaactgacagaacttttcagggcacagcaatatctagtggaccatctactaaaggacttctttatgacatgcaccactgttaatcatattcataagcccttccatctcagacgaggggtgattgaaatgagtgctggatgtctgagtagagctgggaagataacatctttcagacacagcaaaggaaagccccttcagatgagtgagcttgaaaagtcacctgggctcagatatatttaaactatgttcttgagcttgtaaatgtctatgtttactgggtattgatttaatgtcttaaatatcccaacttatcaggaattggactggataggttgctatgagacttgaaaaactggggcaaaatgtaagaaactacctattatctgattggctgaatgctcatctttaagggtatgatagcattaatataatgttctttttatgtatgggagcaatgaattccatggagcataaaaatagtaccaacccagtcaataagggactaacagtattgaggtctgtttctcaactgtgaacttgttccatgacaggtgaatttttgactgaattccagcccaatagcctcagaagaatggttggatgagaggtaattgatgagcatcaacttctgcaatgctcccaagtacaagggcagctgaaatcaccacctggttatgaatcacagccatgtctagcccttcaaataaaaatgggctctggtatgaaaatttgtcagtttgagatatatctcatacctaaaaatgtctctaaccaacaggaacattaccaccatgaaagtggatattaaacctctttcccctgaggcactctgagttcagtgagaagaccatggtttcaatcagagcaatcttagggatcataagacaaaattggaaccatctgggaataacaaaaaatgtcaaagaacaaaaattaccaggcttaggtgaaatctttgtaaagtgctgtgtggcacactggcttggatatatggcttttgctttgtgttttgttgtaagtacttatctttgttatgcatattatgaatgcatattatttaattgtgatgtcacaaggtcattggcctcaggcttttgaaataattctattgctatatcgtagctgaggttttcccgcagaatgatcaggggatcatttctcattggctaatctaaaaatatgaaaaaaaaaaaaaaaagccagaaataattgggagattacaaacaaccttgaaaagaaagatatgggagatgaccaaaatgaactataacatatatagcatacattatggtcctaggtacagaaaatgctctgtacttcatagttagatgtgccaagctcttttttttttttttttttttgagacagagtttcgcttctgtcgaccaggctggtgcaacctccgcctcctgagttcaagcgattctcctggttcagtctcccgagtagctgagattacaggtgtgcaccaccatgcatagctaatttttgtatttttagtaaagacgaggtttcatcatgttggccaggctggtcttgaactcttgacctcaggcgatccacccacctcggcctcccaaagttctgggattacaggcgtgagccaccgtgcccggccatagctctttggtatgtaagttagaacaggctaagcagtagcaaccccctaatgatttaggccacacatggatgtgataagtcaggaaaaaggagcaagccaagatagaggacagtgagctgcccatggcatacaagcaactcacataacatctgggtaatgactatagaagatgactttactccacctggagcatctgattatacctgggctctttgcagtacatgttaatgacccagaccacaaacagagtatcgtggccaagctgttcttgcactgaattataaaagagacttgagggtttgtgcaagctgtttggcaagacaaggttggcttggagtaagaacttctggaaatatcagaaatgaactcagaagagaagaagactaggctgcctgaagaggtaagttccaccctgacagaatgaggctcctccaagaggccacttcataatgctccctgcattctttgtggtactcgcctcctggaatactctttgcaggtactattgcactggtcagggagtacagaggcaaagagtcctcatttcttggactgaaatgtttcagctcagcccctgcctctctttactgagatctgatcagtgactgtacaatgttcctcctaccatcttttcttctccaagctgtctactgaaacctcagcctcctataacccggctaaaaggcttttcagcccttacttttccagaagcatccatcttcccaattttcttagtcttttcctgttctgtctcagaacataaaaagtaaagctgtttctactgttattcattttcacccccttgagctggtggttccaggggaggcccagcacatctcaggatcagctgtggatgagaagatagaggcaacaaaggattcccatagtaagagacctggcatttccccacccatgctcagctccctggacttctgcctctatccaatccatccccagatccttccccaaatccatcccagtccatcctaaatcccagaagctaacaattatggcagagtttgtttttcctcttcatggaattcctggcccagaagttgctggaataatctcagcttggaaacagtgacttcttgcaggtacttgagtaggtgaagattacaagtggccgatgaaggcctctgatctatccctcattctctcccacagggggtgtgtgactctattttttatttgtttattttttgagactgagtcttgctctgtcactcagactggagtgcagtggcacaatctcgtctcactgcaacctctgccccctgggtttaagcaattctcctgcctcagcctcctgagtagctgggactacaggcatatgccaccacacctggctaacttttgtatttttagtagagatgggatttcatcatattggtcaggctggtctcaaactcctgacctcaggtgatccgcccatcctggcatcccaaagtagctgggattataggcctaagccaccgcacctggcctgggtgtgtgactctaagcgacgtgttttctatcttagcatcggaagtcgtagcagattattcctcactaagtgaggaatacatcgcctgaacactcccctctccctccagctcaggctactttcctattcccatgctcctgcttctacccaccatctcattgtgccaggccagtgggtctgagtcactgtccccaactcttcttctctcatccctatttcccctggagggtgaagctgagagatccctggtttctgttccttccctctccttctattagtatctcttttgttctttcttaaagacatttaagtaagtgtaattccacttactgagtattttctatgtgtcaatcctggtgtcaggcatttagtgattagtatctctcctattagaatctcttttgttctttcttaaagacattttgtcatttgtcttccttcaagttcatctcttctgtcctctgacttctcacccccttcttaaatagcactactaattccaaatccaagggctccaacgtctctgctccatgccccatgcagggtaccctgtcactggtcatgcttgcggctatggctgtggctcctgggatgtcctatgggaatccatctgtcactgccagtgtgttgttttggatggggtcactgcctgctctgagatatgagagctaagaccatgttattgtgatgcctaaagaaacttcaaccccaatcagaaaaccctcactaagtaacatgagttatggcttctcaactcctatcccctctgcctgtgacatctatgcccaggtaataaagatggtctttgaatttctcttcgtttgagtctatcattttcctaaggaatagtggatgagaattaaaatagcaccttctgtttattctcctcatttttcccctaccccctcatttcaagctggtggccaagttttgccaactcttgcttcaaggactttggctggaccaaagtagtgccaagcacatgactcttccaatgtgagcccactgaagtagcaaggtttcactgagtgggcagtgattgaaagacattttgtgttagtaaaaacaggtggagagagttccctgggctggcagttggagagaagcctgaaggcactcctagtagcaggtgcaggacagttctccaggtggccttggaccaacccaggtctccctcctttctcacttgtagatctcaagaataatcgtagaacgtgctgagaattcaacattctgaggtaaggtggaactggacagatcagctcaagctctgttccagtctctcctagaaagaggttgttcttcaacactttaccccattgagtcatgccattcccagggtataaattgcaggatggtctgcttccggggttctttagctgcagtgcatgtggggcatgcacagacaagattccatgcaccctggcaagttttcctgaaccttgggggaccatcttaccctaaatcctaggcttctactctccttgatgcctatcggtgagtaataaagttgtttcactttacttgttatgtgagtgttctgtctcactggacttatcaagtaaatggaaattgcagcccaagatgcagcgggcttatattcatttgttctcatattgctatcaagaactgcctgagactgggtaatttatgaagaaaagaggtttaattgattcacagtcccacaggctgtacaggaagcatggctgagaaggcctcaggaaacatataatcatggcgggaactgaaagggaaagaggcacatctttacacggcagatcaggagagagagagagagaagggggaagtgccacacacttttaaacaaccagatctcttgagaactcactaaccatcaggagaacagcaagggggaagtccgcccccatgattcaatcacctcctaccaggcccctcctccaacactggagaagacaattccacaagagatttgggtggagacacagaacaaaaccatattagagctgaagtgataacaagggcacagtgaaactgcttcacagcaagagtgtcctcactttccttccttactttacttagatgaagtaaaaacaccttagaggataagtaccgcatgtttaccagggagactagattctagcatccagataattctgtaacctcaactagtgtctccaaaggtgccatgaagttgggacaacaggagtctcttgtaaatgattgatgataaataaggatttttttttcgttccttagctttatataagacatttaatccaccctgaagtggatagccccaaaaccagtgagttaaatttcctaaaagcctagaagaatgaggacatataggatgtccccagccatatctaaaccccaactgttctcatctcatctcaaggggatttgtgctgtgagaaccaagatgaatacctagtaatcccagtcccctcactattcacaaaactttaattgaacattgttctgagtactacttaggtttcagaggcatgaagtggaatataaaccatcctttgcctatgaggcttgtgagcctatcagggcccatgggtggttttagcacaagtcacaccctcatatttttgtttgtttctggccacatctgctgcttcaccatcacctagggcatgtaggatagttctcctcttcagacagagaccttggggccacaggctggctcatacccttcacggtaagtcattaaccgtcaccagctcacatagacacttggaaagcccatctttctcatatggtgaggatttgggagtgcaaacaacacacagctaagcaagccgtatggacatagctgtctcagccttagagatcttagagatcttaggataagaaagtgacatcccagcccacgcctagaaggaacagaaacaatgagaggacacccacaagatgattggtagaatttttatatcttagacaaagaaaaggttgacccaaaacacagattactttctcaagtttacttttttctttgtgggcaataactggagttcaaaccaggaaggcctcatgaactgttgcaaatgtggttggttaaaaatatttttagcaaatgtttcttaagcacctatggtgcactagacattttggtaggtgctagacatttggcagatctcagtgatgaggatattgcacccacactcagctgttcat

SEQ ID NO: 296 - DNA, 10000 bp, Homo sapien
tttaaggaggcagaagaagggaggagaaaacagggtccagcgcctttattgtgttttcatgggaaggaaggggccaggcaggtgaagcagctgagcaggtttaaaactggctagtttaaataatttcagtgagctctgagctatcaaacagtgacaggggaggcgtcctttgtcatccagtacctggcactggagcgatttagggcagggaaatattgccttgctgtgtgagttagatgaagggggtggctggcagtgtgagctttggagtggttggtttgtacagggcaggtgtgttcacaggcgagttgtttactatctgtaggaattagctctgggaggggcagtctctccaggattagtaagatgctccaaaatgtcaaagcctcataagacacagaaaataaaaagcataatcaatacactgttgtttgaaaaagaaaattgtctttggtgtaagtttgataaatgttgcaaactttgtacttggcttgaatatttacaatacctactggcatagttaaggttgtatgaaagtcttacagtgaaggaaacttttttaacactttaacccagagtttcttacattgatttgaccatttacagccaactcctattaacattagcagaacattaatgctataaaagcatagtttggtaaataccttccttaaccaacttttcacgtattttaaattaggtgatttatataaatctgtgattgaacattaagcaaaacatacactctatacattttatgcattgaaaataatctataatgttgcaaaaaacataccatatgcattgggatatttctgaacaattctaacagaatctttccccatgcaatgaaatgcatgaatacataatcaacaatttccaaaatggaatcttctgaaagacatttactatgcaaaccactctttctcacagacgcagagtgtatgtgcaaatcaatattgttcacctattatagcaatttctatcatgctaacccttatatctgcttaaaaagataggaaaatgatccttaagtttaagaacatccaaaatgtggccattgaggattcagaatcatgcattgctagaaataacttttgcctaaattggaccttctacatatgcaatgagacctgattctgtattatttcatgtactgctaagcctgtgtttctgccagtgaataattattttgagttattagagggaaaatgaagcataacatttgcatgatttccctcaaactacagaattgagtcgacaatttacaattaaaagggaaaaaatcatcacacaaaatatcgagatctgaagacaaagaaatgatattgtttccttttctcttcttcccaagacttgctgacccaattattaattttccaataatgtcatatgtcattcaaatggccaggtactggtgtgacttttagttctttcagagtatcagggagtgagatgccatcttcaaatctaaaataatccagcttcaagggggaaatggagtgtggggaagttgattacctgagatttggagttaaactggagttgagagaactttcttcttgtcatgcctttccccaaagaagtctgtttatggaggataaaagtgagggctcacttaattagctcatgtactcattcaataaatatttattatggaccaacatatactaggtacatgatggaaaacaaagaaattccctgtgttatggaacaaattttgaagtggagacaagtaataaataattaagcatgcaaataaacatgaaaacatataggaataaatggcacacagaaagcactttaatatgatggcaagtgacttattagctactctagtttcagtggttgaggaaagtctctataaggatacaattatttagactaaataagaaggagcggggaagaacattcctcttgaattttttttcaaagtactaacactgagcaagatctttttttacccctgaaatgaagtctcactcttgtcaaccaggctggagttcaatggtgcgatctcggctcactgcaacctccgcctcccaggttcaaatgattctcctgcctcagcctcccgagtagctggaattacaggtgcctgctaccactgggcaagattctttatcatgtgaatgatactgcagtgtaaacaccaactaaaataaaatttatggtgtttggagatgaaaatcaagctaacttgatgtttagaaaacagtccccacatgaacaatttattgggatgttgatgattctctatgcactttgagttttctgtataatatagtttttagttatcaattttcagtcttactttcaaaggtagttgttacatacccatcttcaaatgcttaagagtgagtttgtttccttcaatttgggagtttaggaatctgtgaccatctatgtcctttatagcaatgattctcaaattaggtagcatcttgctcacttaggaaatttgtgaaaatatgaatagctcatgtgtaccccctgtgattctactaaggactatatttcagtgcatgggactctgggcttttattaagagattgtttgctatgtttctctgaattaccctcaaattgagagagccacacagtgggtcaggagagcttgggctatgggtagctgcgtgcagagaaaagagttctgttagataaggggagctgactctcaaataaacctggttattatgctaagttaagggggatccactgcttcagtgctcctctggagggattaatggaggtcataggtccttcagacatgactcagaggcctgttggaggaggctttgggctcccgtgttttcacagaaacgctctttactgttttatattttgtggttacatgtatgacttaactaagttaaagattctgcttctaaatagattaaataccaccgagctatgtggtgaagaaagaaccaggaacaattatttccgaagacccgctgaagtcagattcataaataagattctagatgccagaaatcataggtgagatcctgggagccaggctaaatctccacttgatcttagccaaaaggctgagaaatgatcaggctaaatcgccaggtcaggcttgatgatgcttggttaagacaatgaatgcacagttacgttttctttgcacagaaaaaggtaaaaagggttaaatggtgactaatcgtaatagtaattcccatttattaagaaaccatgacatttcaggattgcaaacgttatgcaatttattccacataacgaatgtttgaggaagatattaatattttcactttccaagtgtgtaaacttgagttttaaaatattaaatgacgtgtccaaagtcccctggtagatcaaggacctaaactgaggtctgtgtggttccagagctcgtattcttaatcacagctttcaatcagaccctaccttagaaaaaacagagctctttgcctgatttcattggtgagaattatagaaaaggtgatgaaaccatcatgatacttatctccttaccatcacgatacttatctcgtttccatcataacttccgtgtagtttgaaaattagtctagatgggccaggtgcggtggctcacgcctgtaatcccagcactttgggaggtcgaggtaggtggatcacgaggtcaggaggtcgagaccatcctggccaacatggtgaaaccctgtctctactaaaaatacaaaaattatccgggcatggtggtgtatggctgtagtcccagttactcaggaggctgaggcaggagaatcacttgaatctgagagtcagaggttgcagtgacctgagattgtgccactgcactccagcctgggtgacagagcaagactccatctcaaaaaacaacaaaaaaaattagtttagatgaaccatctctaataaagatgagaagatggagaaagagaatacttctttattctccatctatctcagattctaagaggcagtccttgcttgaagaaaaaggaagcaacgtaaaaaaatcagagcagacaagcgacctgtcagtcagataatgccaggagaagagtggggatgggcacattgaagcatgaacaaatcaaagatttagaagtctttccaattttaccaagccataccaaaccaaaccaattaatttaacctactctttgtgcttttaccttattattgctcataaaccagaaaaaatattctgttgcttccagtgatttacactttgctgtgaatgcttttaaaactgaaactgtcccagacagaaatgatggaggtctgcttccaaaaatgtctggggccaaataaagacccattcaagtgtgtcatgaatttctgacttcttaccatcacgatccctgcatgggtagcttcatctgtcattctgatttaataatttatttagggcgatctcatatactataagtgagtccaaatacatggtgagtccaaatacaaccaaaacatcattttcctctaatgactatataactgtatttttagatttaggcacatttagagagagttttatcgtgtattactgatttttttttctccaaaacaaaattaaatgtaataatgctgtaactgcatcagatgctatcaagaggaacgtgtacattagcttcttcctttggaaacaggaattttctggtacatgtttgtttgaatatcaatcggcacaaatcaaatatccaaaatgtgtaatatacttaatgataaaaatacctaactggggttgtgagcttcagcaaataaataaagcttttcattggccagattccagccttcagtgggtggaaactcttaatgtaattgagaactaaatagcattggagtctatggtttttcccattcaagtcttggcttagctgctgacagtcaatttttgtgccacataacctaatttttctcagacaaaagatagcaaatctgatggctaacttttttcctggaagggtatgtaagaaaactgtttatatagaatccggtgtctggccacgtttttaactgatgcttgtcaatgactcaacagtaagaagtgagattcaaaacaacctcagggataatctcatatctagagcattaaattgtattacagatattctgaggacagaaataataaactgccccattatatgagggatccattttccttggggaacatcaggaatgaaaagattcctatgctacattgttttaaacaccagtttctatgtcatttatgaattggccaattcttcttataaagggccagatgatgacctttttttttttttttggtgttgcaggccacatatagtttttatctcatctttctctattttcctcccttccttcctttcttccctcttaaaaatgtgaaatcattcttagctcaagggtcatataaaaacagtctgtcgagctcttaatcctatttactttttaggggcattaggtcataacagcactcggcctagaaaactgctcagtcaaaaagctaagacagggtgaggatgcaaatgtgattgatgaggtttataattaagagggggttagcttcaaaattctggatgactgaatgcccaccagatgtttctattttctctacctacttagctgtgactatgacttgggcaaaccagagagatgaaacacttctaggcccacccattgtatttttgctgtcatgcaaaaactctctgaatcaaaggcagcgccagtattggagtgggcagaattgtattctcagttctccattctttctaataaccttaatttaaaaatatgataaatgtatgcctctccccaaccccatcttatggaatgagctgcagaaatgtagctgaaacttctaatcagaagccaggctaagaatgtggactggtcacatttctcagcctcatggtttgattgatgatatatttgtccattttgaagaacaacagaaatgatgtgtaggttaactagtttgaattatctgtctccttctgcatttgtacagatatctgagttggctgtgatagaaataaagaaataatatctttaagttacctacatttctggaattttttttacataagaataatttcaattacattgtcggtccttataatacctgagttaccaaaggatcactttttaaaacagtattagtcaccaaatgaaccattcacaaaatgaagaacagttaagttccttgaagctaaacattaaaggccagaatggggccaacactgatagtttgctaactctgtgagaaagaacacaaggaatatagaaaaatcatagttttgaaaaataaaaaaaggtatgattgaagaatatgcaaaggttctcattttaaaaatatcttatattcagaaaatgccataagaaataaatttatattttcccaccaagaagttggatatctgttagggcatttgatgcttttcttttttaaaacttgcatgccaacaagtatatttagtgcagagtttaactttccataaaaatctttgggttaaagatattggagagtaggaaaagggcatagctaccatccaaatacagatgttagggtcccagccagatggcattactttgatacctcccttcctgatttttggatcaaatcccttgtcccagcagatgtgaatagacatcataatactgttaccattctcagcttggtaataaaagacagccttgaaattcaagtagccctttgcctctgcatcaaacttagctctcaaataccttcttgatagtaaacataatgttgaataattcacaccgtgtgactgaacctacttgggatgacacagaggggcagagctgtatgactaaagttaaatcagaaagtagagatataaaatgataaataatctttccttgtaaacacaaatggcattacactgaaacacgttgaaattatatggtatttgcccagaatgttcttgagtttgaggaaatttaccagaatatctgtcaattactcctaactaagccatgctaaccaactctttgccttggaatgtgtattcaagagaacaaaaacccagcagtctctgtggtggaaagcagcagtctccagttaactttagcagaaccaggtgcccaagtgactcagaagtgatggtatacaaaatgaaaaggtattgtcaacaaccattacaaaagaaagagctaaacagcttaaaagtggagtacagaaaataataaaaggaagaaaatgtctgcccactcaaagaaaaatgcactccatgatcttaattgctcacaattgagagtttaagcattcattatttaaaagttaagtcttttatgcataaaaaaatacagagaaggcctgagcaaagtgttaacaagtaactagaagcacttcttagcctcaaattacctatgaggacaacgtatattgagcacaattgggggaaaatattttaattactgcatgacatgttcttcatccttctactgatggattgattatatttgtgttccagaaagaggccctcaaattatgtaattgaatatccctgtcttcccaaataatgatgctaccctgaaaacttgatctggaagtagaaaattacttttttttttttttgagtggccaagcacaggagctcaaacaattctgccaataattgcgatgttggtaagtcagtaccttcaccagttttacatatctccttccatatgagtgagacatgggcagattggtgtgttagaaagggtcctgggtcaaagtttcaggggacatgggatgtaagactagaccatcaggaacccactgaaatgctactgagaaaattctgtcatctctttccatctatctgcttcattttgagcgaggatgtaataactgccctcccagaatcagagacgtacagggtaatgtacctggacatcatcaaatgtgtacacaaaaaaagtgctctagaaatataaaagtagggaattgttccacatatggcttatacgaatcttttccaagaaaaacaattcctgaaatgttccttggaatactcctttggacattctgaacttggcatcttctcagtctacctgctctccatcttttccaaagaaagcattatcctattgacctctgtgttaagaacatcattcctaattcaccagtgaacccttcagatctactactaaagtatgccctaagtctgtccgcttcccattatttccacaactaatgtcttagtcctgacctcatcacatctgataagactcacctgactgttccccttgctgccacatgtagagagagtacagtctactttccgtagaacagtcacagcaatcctttaaaaacaaaaagtcttcagttcaaacccttactggtgacttcctctcctgcagagaattttatcctttgtactaataacccccacagcagggggtgactaatgaccttttctgtatggcctgcaggttaggaatcatttttccaattttacatggttgtcacacaaaaattatattgaattcaaatttcagtgtgcataaataagttttattgcaaaactgtcacatttactcatttatagattgtgtattgctgctttcattcacactaaaacacagaattgttgatccatagacattatggtctgcaaagcctactatgtttaactttttggctttctacagtttgtcaacttctgctcagattgggtgacttctctttttctaccattcacattgttactctgctcccaccatgccaacttactctgttaagcttgtttttgttatggtattattttgtcttttttccccctttttgtggagaatgggatctcactatattgcccagtcaggtcttgaactcctgggctcaagctgtcatcctgcctctgcctccttaagaactgggattacaagcatgagccactgctcctggcctatggtactattttatatgttgtttccttttgcccttggatactatttccctgaatatccaaggacttctttcctcacattactctagaatttaattgttacctttctgagggagggcttccttgaccacctataggaaatagcactgttataaaaataagaagaggacacaagtagtagtttgtttctgaaatataatcccgggtttgtctgaattcaaacccttcccatttagatgttgaactttttcactgttaagaatcagtgttaaatatcagatatttaatagtcaatagctcagatatagtttagaggacaaactagaagtggaaaatgacatgattctctttttcccagttcttccaagagcttagtgtgtgactctggaccaataatttagtacaattaagcctcactttttctttcaatgactgaataattatttcctttgatctgcatagtaaatataatggttaaccataggcataaccattacatgaaacaaatgactcaacgaaaatagcaagaacaaccaaacatccccagaacacattaagcatgtatcattctcatcaggatttaattttacattcttaaatcccagactatttaaaaggcgtgactgtctttacaaaaaacttgctaagggtatatgtaacaatagtacttgtattagtttcctagggctgttgaaaaaagtaccacaaattgggtggcttaaaacaacaaatatatcacatcgcagttctacaggccagaagttcaaaataagcaggttagcagggcacattctttctgaagcctgtaaagaaactcttaccttttcctagatattggtggtttcctggaaatctttgtctttccttggcttgcagtggcatgtaactctggtctctgccttcactttcacaatgcatctccctgtctctgtcttcacatggctatcatctttaaaacaccagtctgattggattaggggcccagcttactcctgtatgatttcatcttaactaactgcatcagcaatgaccttattttcaaataagctcacattgttagacaatggaaattatgacttcaacgtattttttgaggggaggcacaattcaatccacaacagtactcat

SEQ ID NO: 297 - DNA, 10000 bp, Homo sapien
aaagttgatggtgtatttagaaaatcctaataagaattttaaaatatgcacgataacatggaaatttgttaagatagcagtataagaggtcagtaaacaaacatcaataatatttgtatattatagccacaagcacttggaaaaaaatttcacttattaagacactaaaacgttatgcaaggggtcttcaaagtgttcatgaaaaatgcatattatgaaaacattatgcatggatttccattttttttgcactgtaataaattcatactaactttttataaaacgtctgaagaggatctagtttgaggcatacaaaggatacaagatgagtttgaaaagagcccctactagagcaacatgaattccatgaaaactgaagaaagaacaaacatcaaatttagaatgaagcttgggtggaagaatgagatcactgatgctttatgtaaagtttatggggatagttacccacataaactcacaatttacaaatggataacttgtttaaaggagggatgagaacagtgttgaggatgaaacccacagcagcagatggtccacatcaaattgtgaggaaaacatttttcttgttcacgccctagttgaagaggcccaacaattcacagcaggagcaataaccaacaccatagacatctcgaatggttcaccttacacaattctgactaagaaattaaagttgagcaaactttccactcaatgggtgccaaaaccattgtatccagatcaacagcaatcaacagcagtgctttcaatagaatttttaaacaagtaggatgaagattctgaagcatttctttgaggaattgtaacaggagatggaacatggctttaccagtatgatcgtgaagacaaagtacaaccaaagcaacggctaccaggaggtgaaagtggtccaattacagcaaaagcagaccactcaagagcaaaggtcatggcaacagttttatggggatgctcaagccattttgcttgttgactttgtggagggccaaagaaagatagtatctgtttattgtataagagtgtttagagaacgccaaagctttatcatagagtccttcaccaaaacaatgctcctgctcattcctctcaaacaaggacaattttgcaagagtttcagtggaaagtcattaggcatctgccttgcattcctgatttgtctctttctgcctttttgttttctaatcctaaaaattatttaaaggacaccattttttcttcagttaatagtgtaaaacatgttgccttgtcatcagttaaattctcaggattcacagttctttagagataaactaagtggctggtatcatttcttataaaagtctcttgaccttgatggtgcttatgttgagaaataaagtttacattttttatttttaactttcaattccgtttttccatgaccttcttgaagtccccttgaatatttaggaaaaatttcacaacaatagtgaaatacctatgtaccaaaaactacaatccattgcttaaagaaattaaagaacaactacataaatgaggaacaacagaaaaattgtttatggatggaggactcaatagagttaacatgtcaattttacaagttgaatttatattcgatgcaattctaataaaaatttcaccagaagttttactggggtaaatatttatgagcaaattctaaaatttatatcaaaatgagaacttagaagagccaaagcaatttttaaaaagagaaagttggagaatatacagtatctttttccaagacttactataaagctaatcaatacaatgtggaattagtgaaagaataaatgtataaatccatggtacagatcccagaaaatgacaaacacacctactgtcaagtgatttttgacaaataaactaaggtaattaagtgggggtaaagaatagtctttttagtaatggtgctgaagcaactggctctccatatgacaaaaaaattgacccttggtttttatttcatactaaacataaacattagctcaaaatgcatgatataactgtgtgtgaacacagaaattataaaatttatagagaagcacttaggagaaaaatcttagcatttccactttgtccacacaaaaaagtatgaaccatgaaataaatttttatgctagtatattataagtggtatattggtatattgtggtatgttggtatattggtggtatactggtaatttggattaattcaaatgaaagtatattgtgctttgaaaacacaccattaaaaataataggaaagtcacatactgggaggaaatgtattccatacactcatctgaaaagagatgtctatccaggagaaaaaataactcctacaactcaatattaagatgacacatggagcccaataaaaattggacaaaatattagaacagatactttaccataagccaatgtgttcatgaaaagatgccccacattattcaatttcagggaaggtttattaaaaccacagcgagttaatactacatacccgttggaatggctaacactgaaaagactggcaatacacaaaatgttggcaaagatacccagcaactggaattctccaacattgcgggagaaagtatcaaatgttacagccactttggaaaactgctgggttttttcttatacatttcaacatatctctaccatatgatccagccttttcaattctagctgtttacctgagagaaacacctatgcctacattaaggcttgcacatgaatattcatacagctttacttataacagttcccaaatggaaagtacccaaatgttcatccacaggtgaacagatgaacaaactattgcttatttatatagtgaaatactactcagcaataaaaaatctactgatgtatgcaacagtatgtatgaatctgaaagtcagtacgcaaaatgaaaaagccagacacaaaatccatactgcataattccatttatatgacattttataaaatgtaaattaatctatagtgacagaatacaaatctgaaggcctgtctgaaggccaggtgtggaggcaagagtcaaagtgacacaagaaacttttgtatgaatagaaactctctgcagcttgattgttgtggcttcacaggtgtataaatcaatgaaagctcatcagattgctcaagcggtactttaaaaggtacatagaaataccagattatgcaacgttgtttcaggagaaagacattcttgtttcttggatcacatgtaagaagcatttgaacagatgctagaacagcattctcaacatatactcactattctgttgcaattttcctctacagtcttgggggcattaacatgataatgaagaaaacagaaggtataaaatcatggggcaggtataaccacacatcaattcaacacgaacacagaggttaagacttagagcttgttagctggtaattgtcttgtattttgtttaaaccacaggtggacaagcccgccataaccatctcttttccttacaagttacccatcttccactaggatggaataaaagaattatagtgttggatggggtcatttcctctttgtaaagatgaggaggatagaggactaagtagattatgaatgacaaaggcagtgggtgatgagaaatgagacttgatacctcctgacaccccattcagcgcttcctgcccatttttattttacagtaaaaacacacaaaaattacagctgttaagactacttacatccataagaattttttcaaaaaacacaggaaatagaaaacatgtgtggctataggtgaagaattgaagcaaatgagagaagcaaacattatgtcagctccagacactcagaaataaagttacaacttttcttgatcccaatagcctgatacaatgctaaggtcatcatagactaattaatcaaattacattttctagtctacctgctgcatttcttactacattgtaattcccctgatgaccaagacatggctttttcgtttttcttgtttcctgaagattctgatatacttcctgtcacatagttgatcctcagtgaacatttataataaattgagcaactgtcaaatgtcgtattttcagggagcaatccgtatactttcatgttgcctttaatgtttattctggcattatatatatttttgtccatatgtctgtgtgtaaaataacaatgtgtattctcgtcagaaggtattttctatttcaacacctgtgcaagtagaaggtgaaaatccttcccaaatgccgcaagagctcatggcaaatgcagaactattgttaagaaatttttctcttgagcctgtaatgtcatagcacttcagtgagggcagaagaaaagacaaactgatattacgtatccttaggtaaaaggatttggggctattcctgactctctattgaaaaaatagggtaaaatctaactaacataatttcagtgttattcaatgttttgttaatgggggaaagcatcattttaactacagcaatctatagtgttatggactgattactagttcaaatgacagagtcctacagtgaaacccataattttacattgcgttctgcaaaagatgatggcagttcttcacatttaatggtgttgctagctcagaatcttgttaacactcagagtctgagaggttgtgcttatcctttcttattttaagccagaaggaaaaattttcaaagatctattggcctttgtttttcacgtacgggattttggtcaattagaaaattacaaagaagaggcacctcaatttgaaaatttgagaatagaatgataaaattataaagaaatgaatttttttccacaataaaaaaaaagacaagtactgtggtttgacttgcgtttagctctttgtagctatttctagtcactgattctatggaaagtcgctaaggagttagtcgcttgttactgggcaacaatttattccaattataactgaaatgttgctaatagacagttaccggtggataagaacagactttaaaaatgaactattaactccacagcattttctcttgttgtaaagaggcagaaattattctaacaattgacactttgtaatgttctaaggtctttttagacatttcaagcgctctgggggcaccggtgaggacccaggggcggcatggttcagagctgttaaatatagagcgacacaattagatagaatagctatagagacccgagaccaaatgttaccagcgtatggaatgccacattctctataagatgcaaatagcatacaaccttcaaaatccataggagttttttttttttttttagaaaaaggttttaatggacatttggtaactacattctgtttttgacaacctccccattacatttctagttatctattcaaaaccaaaggacaaaaaataaaaaaataaaaactacaccagtttacaaagaacaatggggcgaaagcaaaatgtattccttgctgtttcacacgtgcttttaaaggaaacaaacaaccaaacaaacagagaaattgtagttcctaagtttcttgacccaaatccaagcagactcattgacaagcctaaacctctccgtgtgtcttcctgcttctgaggctaaaatatggataagctcaaagtttgacacatggatatattttcaaatgacatgtttagtgtacaaaaaaagagatgtctatgtttttttcttctttataacattaagatgtgatgtaaaatatagtagccagagttgcatttttcacatgagcaaaagttacatgcagaaaaagaacagaagttcgttgattgtaggatatgtaaccttgagaactttatcttatagccaacggtcacacattctgaaatgtcttaagtgatctggtcagtgctaaaggtagtaagaaaatctggttgctgaaaatttacactatctaatttcagttattcccccacaacagagtaacaggcaagcacattctcagcagccgttccaggcagagtatacacagaaatacttgttgaatttaattgggttgaataaaaatttgtccttttgaggaacaaagttagcatctcaaatacaaggtctgcaaatgatgtaggttcttcttagttggctaatgaactcctgactagttacagatgaaagggattaaaatgactttactgagcactcactttagtctgtttcattatctgaactaaggaagtctaagacaattaggattccttaaaaaaaagtttcatcattgcacttcctgtttgatgagtaaacagcagactcgttatggtctgcaaggtacctattaaaacccgtaacatccctggaaggaagtaacttggagaaagtcaagaaatctttctgacaggacaccgcaactccaaacaatcaacaactcattgtcatagtgcgacaatcttagccctgttgcaactgggcaaatagtccatttgcagagagaagcatcatcggggtagacaggaatgctgttattaaccattataagtatgacgcgaaggtcgtacatcaggctattacaccttttcattatacgctaacccctcacggcagggaagccacgcttatgactgcattagacagacaaagccttcagctctttaaaaaaagaaaaagcaaaaaaaaaaaaaaaaaaaaaaagatgaaaaaaattaaactcgttttcttaccagcacgttgcagcaccaactcgctcacaggaatgttgccttttacaggtttctcttttaattatcctagaagcagggagagaaaaaaaaaaaaaatcaaaaaaaaaaaaaaaggcaaagaagaagcagggtggttaaattagcgtgctggaatcttttcagtttgtcgcagagtagaaaaataaaaaaaggaaaaaaaaggctcagtaatttaaatttgctctcagttcaggctgcaatgctgggtcccgccccttcttccggctgggttccactacctgcaaggctggaactgacagccactgtgcaaacaaaaaaaggcaacaagcatgctgggaccattctgtctgctgtttgggtctcacttgtcctgacaactaaaaatcatcagtggaaaggtattctacattttttatttgaggtattttatttgaggtatttgcatgtaactcccattcattttaattgatacaccatagtacatgatgttgggtttgatttctgtttggggtgtaattttttttctttttctaaacatctataattattaacactatttttactatgacagtttagtgacatcttgtgcatttcttactgttcctgtctcctgctccaaaacacattctttcctgtcttttcctttaattcctaaacactgaaatttctgggaatatagagatggaaataccaagattagtaaggtttccacttctgctctgactctttctttttttggggatggtgggagggctacagggaggtgcatcatactaagaatagtttaagggacagagggcctaggatgaaggtcccatcaaccccagaaacttctaggaaggatgaaatattcaaatgaaaaagtctccacaacgaaatgcaagaagtttattttcgtatttatgtattgtgcaaataactaaaaataatggaaataaacttggtctccattgccaattttacctaaggtgtctcctatagaaaaccgctttaattttagcaagaaaaacctgatacttaacgtgcagggtattgcgagtgtgtagcagaggaattatgaaagagaataaaccccatccttcttctgtcaggatgtaaattgcttgtgcagaattttcaacaaggttttttttgtgtgtgttgttgttcttttctaaatgctcttttcagacgagtgtgttagcgactacttcagtattaaagctatcggaagactgttgtagtagggaacatctataaagttgcctcttgatctgaagcactgcttttatgaaggtttatggcattggtgctcctatgcaagtctggatttttctctgatcatccgactaccctaacttgagaggaccatgctgactgatgtgtcatgtcccatagctgggggtgggttgctaaggagtaaaatatataattgtacacagttcttcaacagtggccaaagacacagaagagagttactcttgataacatgattgtgcttaatctactttttaaaataaactattatttacctcttatccctacctcaagccatttaaatggatttcaccatttctgcacaacttgcagaacctcttaaattcaaggacgcactgctttaatgcatttcacttttaaaaatcagactttcaaaagataaatgattaaaaatgtaatttaaataaatatgagttcactttttaaattggtaaaaatttagctgtcaaatatttgttctgtcatttgaggtctcatcaaaaaaccaaaccaattaaaaatggaaaggtctgagatgcacagagtgaaactccatctttgtcttgtattataacctttaccaggattatttctctactactgttcagcaatgaatgcctttgctcacttcctactaacagctgtagcatagaaaaaaaaaaagggcaggtcaagtactcaagaagccatgttaacttcccaaatagttatgcaatcagctttaatgaaacagtggtagattacaccaatgtgctaattataggactttgtcatagcataagatgcaacgaaacaacccatgccttggcttggaaagtgctatgcatagattatttcaaaagatttaattgaagagagattttattttcctgaagcattctacaattaagtggcattctttcaatcctttctcttttaagactagttctggacaaaaaaaaaaaaaaaaacaaacctgaaaataaagtaatgacttaaaaaatatcttactacaaatatgactaatttgccaatattagttactttggtataattttgaacataacatacttagaacatgttagggaatatcaaaatatacagagtggcacatactggtttatattctgaatgtctattttaaatgaagaaataatacttttatgttcatcaatgtttattgagttcagttagaaaaatattaattttttaagagactgagtctcactctgttacccaggctggagtgtagtgacatgataatggctcactacagcctcaaaatcctgggctcaagccttctgtgaaggtggggctacaggtgaacaccaccatgcttgctaattctttatttcattttttgttgagataggggcctgtgttgcccaggcaggtctcaaactactggtcgcaagataacttcctacctcagcttcccaaagtcctgggattatgggagaatgttaatttgaattaaaataaaataaccctgacattaaacttaagagaagggacatttttgtttggctaatgtcaactaggttttagcaaatgtgtgagacatgtgattccactagatatttaacctattatttcagagaattttacttggtgctggagagattaagcaatatattacatatctcacagccatactggaaaaaaaatccacttcaaaaataaatatcccactaaattgttagggcattctgtggagtgatacacatttaggtggctttcacatcatggagatgtgttttaaagaaatacactgaacaagtttcctggagatatattttaaagaacttcttggaattggcatattgtcatatgctatttaaattttcatgctcagagaaaatatcgaggtgggaaacgctaattcattttttaaaagctgtatcaaatcaatacatcttagtctttccagttataactgataattaaatatcattttcaaacttcttgcatatattaaaattattactttttgataaatgtattcctcattatgagtcaactgtcttcagtgtaattttactgttttgtcttttgggcagtatcatactgtctaataaatcatatgttgtggctgtgatatcttattgactaca

SEQ ID NO: 298 - DNA, 10000 bp, Homo sapien
tttttttaaaaacaaaaaagtaaatattaaacaatagcatccaaacatataaatattatatatatgcacatatttacattcataaaaataatgattagttttctggatgaagaactgaggcccagaagttaactagattagtggctcaaggtaggctgcattttagaatcaagggcagtgatgcccaagtcacagtgactaatggcatcagaatctcttgggatgggacccttttattactattttgtaaagctccccaagttaaacttgaaaagtgaattaggtcatattaggtcagagattaatacaaattgtactactgattatcttaccctagcaagtgtaggttaatttttacaatcttcttatgtatgctgtttctaataaaaggggttgttctcttgctcaatctaactaacaggtgagctataaaatcacacaggtgatcacaactctatccaaagaatggtggtgctccatccttaacctcagtactagttcttatcctcaggtgcttatcactcattcttgggacttcaaaataaatatatagatatccaggaaccaccttagccaagacaaatcaaaatcaatcactaggagagacacctgagcatatgaacttttaaaaaggttcatgattttgatgcctcaccctggatggagctctctcatagtatgccacacggtatgtccttagctgtattcattaatattacagggaagcagatttcagtttaagagaaaacaatgaaaacaattcagagctacccagtaatggaatggttttaaagcagtgagttctctgtggctggaagaataaaagcaaaggttgaactatcacttgctgggaatgctatcaaggggtttccaaattcagtaagtacttgcatcacacaatatttaaatttcctcacaattaagtttctctagccaaaacttccaacagatcacatataatggatatagacattgtcatgaaaactcatgattttaccagaaattatcacagttaaatggattagaatttagtagtactggtcgaacattgcctctgacatcagccttattgaggggaatacttttcccctcctcttcatgcttggatggagggaagggaacttctccttgctccttcaaagcaagaagtgtaggaaaaagctctctgaaccctcattcattccttcccaagagagaactgtcttatcccatgggtgatacaagaaggaactgagcatgtgtggtccagcccctggtggtttccctgaccttgaaagctaactggtctcagaatgcaaagatgggctctgccccaacaaggcagagacccgctgttctctccaatcagggagaaatattacagtctctgactggagaaaaagtcaaccttcttctctgtatcagtttattcactgataaagtggatatttttctcttcctctgactcccatttcttatttctcaatttgttccaaagtgaagaggggaataagaagttacctgttggtgtccttaaacccctcacgtatcacaatatagcaataaattgtaactgtccatctctgtgatacttgtgttctgaaatgccattgcattatttttttcaagtcaatgaacattcatattctaaagtacaaaaagaacaaaacattatataaagtccccctttctttactggcataaaaaatttgagatttccaactgctaaattgtctatccctaggaagtaataacatttttcaagtttccactttattgggaataatcttagtcatgatctgcagaagttggtcctggacaatttgaagataggtcttctttatctgtaagttatgtgagggaaatgaaagattaatacaacttctacagtaaactagaaaattatttcaacataacatgcattttttgatctgatgttttctacttattctgctaaaccagaaaagataaaaacaacaataaccaaaaatgcttcactctcaagtacaaagttcttaaatacaagttagcaaaggtagcttgggcaaaggtgttagaaggagaaacacttggctctgtaagacacctggtaagtgtaaaccatttctatccttacaatggaaaaaaaaaggaatggatttcaacatatctgatttttacggtttaggggcaatattctatctaagtatataaaaattagctctaaaatttaatataaattctttcaaatatctgtagccaaagaaagaatctttaaaaataaagcacaaaacattcatcactctcaggttattctaaaattgtttcttttgaaacaaaacactgaaaaattcacttccacacattcagtttctgaaaagttaaatgcaattttaataaagcctcaattatttctatatccactatttaagaaattggtcccatactgccatttgaatggaataagaaatttccattgtcagtgggaaatgactttaactaaaaattggagagcattcatctatttttaaaaagcataaagtaattttcttaccttcataggctgttccacaccaaatacaatatagatgttcttctcttaaataactagtcaatatttgtaatttttccagtacctataggatacaagcacattattaatactttacattgaacagaaccttggttttctggctcttagatcgtgccgaattagctcaaggctgtaaatattctgctatactctggaatagttattagaaatgtcaaggacagaactgatatattcgaatgtgttacagttcattagccaccctgagatttccacaagtctgccagacacaatggagactgcttgttaacattgagaaaatagtttttgggtggccttattaaaattggcatcctttaaaggctttttctactttcaaggcatttacctcccccagataaggtgaaggtgaatatggcctccttttgccataaaagttctcatcaatggtctcccaattaagtggaatataggtttttcaaattgtgaatgttttccacaaaattattatactcaagtaagcatacgagtgtgttttcctttcttgaataatctccatttccttttttttttttttttgtgagacagggtctcggtctatcacctaggctggagtgcagtggcgtgatcttggctcaccgcaacctctgcctcccgggctcacgtgatcctcctacctcagcctcctgagtagctaggattattgggtgccccacacctggctaatttttgtatttttagtagagactaaaatacactaccatgttggccaggctggtcttaaactcctgacctcaagtgatccaccagttttggtctcccaaagtgtttggattacaggtgtgagccaccatgcccggcctccattttcttttgattgtgtttttttgttgtttataagtaggagaaaaaagtacacattagaatgacttgtagaagttttgcaggaaataaggtataaattaaaataatttacatttgttgctaattcatcatccaaactgaagctgagatgagaggacaaatggaagctaaagggaaaaattatatgtaagttttgatttggggttagtaaagtaatcctgcaatgcagtacctctcaaccaggggttatttttcccctcggggacatttagcaatgtctggagagggttttggttgtcataagcaaaagtgcaactggtatctggtgggcaggggccagagatgctgctaaacatcttgcaatgcacaggacagctctccacaacaacggattaccacaactcaaagtgctaatgttgccaaggctgagacaccctatgaaggaaatggtgcaaagcatacgcttaaatcttcactcttatattcatcttcatcctgttctttttcttcttcatcttcttcagtctcctcttcaagcctcaaccagtaccatgcttccctgggaacctgaatattctgaaaatgcagaagtagtctcaattaaacatactaaacataagagcatgacaaatatgttcatgtcaacatgaattcattctttcaatacgtattcactgagtgtggctttaagagtaaaaacactggccgggcacggtggctcacgcctgcaatcccagcactttgggagggagaggtgggtggatcacgaggtcaagagatcaagatcatcctgaccaacatggtgaaaccccatctctactaaaaatacaaaaattagctgggcgtggtagtgcatgcctgtcgtcccagctactcaggaggccgaggcaggagaattgcttgaacccaggaggtggaggttgcagtgagccaaaatcacgccactgtactctagcctggtgacagagtgagactccatctcaaaaaaaaagtgaaaacattgtaccatgaactatggggatgcaaagtccaattctttagaattgtgcagttgtctttaagttccttctgacagtctagcaggaaagataggctatgggtacaaaataatacatatatgctacaaaatcataagtgccatgaaatacattcaaagtaaagtaatatgtaagaacaggaaagtgagagattgcttccagtaatctatatataagggaaattttacaaagctttttgagacttcaaatgaagtcattttattttcagagtacttgaaccactaagataaaagcaaagacagaatttatttacttatttattttttttgtagagctggggacttgctatgttgtccaggctggtcacaaactcctggactcaagcaatcctgcagcctcgtcctctcaaagtgctgagattacagacatgagccaccatgcccagccagagacagaattttttaaaaactattcaaatttgaactagatagcattccaccttgattttatttttgagacagggtctcactctgtcacccaggctggagtgcagtggcatgaacatagctcaatgcaacctcaaccttctgggctcaagtgattctcccacttcagcctcctgagtagataggactacaggtgtgtgccaccacatgcagctaattttaagatgttttgtagagatggagtcttgaaatgttatccaggctggtctcgaactcctgggctgaaataatcatcctgcctttgcctcccaaagtgctaggattacaggattgagccatcatgcctggcccactctgattttaatagttagacatatattagatactgaataggaactgaaaataggctattcttgttaatcaaatattataaagaacagaatttctgcacataatagtcataactgatattcaaataagcagagaacaattaaatgtaaaattttatttaaccctttttgttttactatagttagtataaaactataaaactatagttactataaaaccctgggttttatagtaacccagacaactcaggttactatagtaaataataagccatttttatatcaattgtcacagatcagaagtgcacattacatgaaagctttaatgagtagataaaccgggcttggagttcttagttttatatatatatataatatatatattatatatataaatacataaaatatatataatatataagacatatgtaaaaaatatataaatatatatgatacatataaatatatgtaatacatatataaacatataatacatatataaatatatataatacatatataaaatatatatatatataataaataaacgggaaatcacagggggtgccaaaacactttactaaactgaaagctggtaaaaggcttactttctggacatccagttgttgacaggctcgctggcttcttctgagatctccttctagcttcatttcatcttgcttatttttaagtcgcattctaattgaaagaaaaaattgtaaactaaaggtctacgttatctttaaccattttatatgcccaagtaccagagaacataccacaataaagaggaaatagaaccaaaaccagctcaaaaatagttttaccgaaactgttctgcagctttttcttcagcttggtttttcatgtgaatcttttttctgtagctttccaatttttcctctgctttccgttttaatgatgcctcatgaccaatgccacttttccctattcaaacagaaaattctgatgagaaacatcctgactttgtgcttcaaaacaagacgatttaactatgtacaaattaaatgcaattctcatttgagtactatcactcacaaatcatttgagtacactaatagtagaaaacactagggttttttttaagcccaaaacataatctgatttttacaaagattgttaatctcatcttatagtaatattataaacaatttttcaaatcagaaaaacagtattagctgttatagttttatttaaatatgaataaaatatatctttttctcttgaattcatccaagtattaagcaaaacatttggtagataaatctgtctcagaacacttttattttattttatttttatagggacaggctggtatgtagtggcacaatcatggctcactgtaacctcgaacttgtgggctccaggaatcgtcccgcctcagcctcctgaatagcaaggactacaggtgcgtgccactacacccggttaattttttaaattttttgcagagatgaggtcttgctatgttgcccaggctggtctcaaattcctggctgcttttttttttttttccttgagatggaatttcactcttgttgcccaggctggagtgcaatggcgcaatcttagctcactgcaatctctgcctcctgggttcaagcgattctcctgcctcagcctcccaagtagctgggattacaggcatgcaccaccatgcccggctaattctgtatttttagtagagatggggtttctccatgttggtcaggctggtcttgaactcccaacctcaggtgatctgcctgcctcggccacccaaagtgctgggattacaggtgtgagccaccacgcccggccaactcttggctttaagcaatccttctgcatcggcctcccagagcaaaacagttttaagacatttcaatggacaaaaacagtattgcacattcaatggttgtaatgatttgttcttcccatattcgtgtggtttaaattttattttatactcactaaaacttatttcttttctggttgaagaggtttagaaatttaacaaaattttactgaactgtaacagtattatcatttaaaaaaaagtatttattgagcaaatatatgtggtagacctaagcgtaagttattattattggcaaatatgctccaaaataattacgtacctgttttgatattgagaggaattggttcaacaataccacccccttaaagagaatgaatacaaactattttagaaaattttcctcaaactacagaacagtataagtatgcaactttacaatgctctatgcatatgccctcctgtttcaatgatattcaaaattgaaatctgaacatctatatatattctatatataatcaattatctaccttgtcttcaaatacctactcatcaaaaaggctgattcacagcctcctatgccacctgaaggtggagttttaagaaggaacaacactgatattattggtgcaagacggtgacagccttaagtgaaagcaaagcaattacgataaaggaaagaaaaacggtttacagaggttactataaatatatagcctctctagcttaataagcagtttcacttcctaaaaagagaggtgagaattgagcctctccaactggacggtcattcagatggctgccacaggtacagagcaagcagggcaaagtcttgccatcatcctcagtgttgtttcaatgtatttagccattgcacttctcaacccatcacttatcaccattctttgcttcttctgttgtaagccacatccatctaggttgttagtgccttcagctaagctgggctgataagcagctcttgatggcacatgtggtatctaaaatggatgtgggatgatgaaaagctctccataaggcttgttaatacataatagactaaaaagcctaagttgttataatttctgtgtagataaagattaaagcatcagctttggtccttatccataagtcacaattaggtggtaaggaatacctgtttatttccacatgtgacttaccactcttgccaagtgcctgaccacttttatagcccatcttttggagcaaggcaaaccctttgttttcacagcctagtgcattcttcaacccaatgtcacgtctttcttgttcttcttcttttaaactcttctgcctgtttttcaaattggcttcctgttgcttttcttcttttcgacgggcttctcggatttgccttagcattggcaatcctggtctgatatcttctctgaataagggaaaagtttattttagatgagtccataaagttttcttttctttttttttttttttattttttgagacggagtttcgctcttgttgcccgggctgtaatgcaatggcataatcttggctcactgcaacctccgcctcctgggttcaaccgattctcttgcctcagcctcctgagtaactgagattacaggcgcccacgaccatgcccggctattttttgtatttttagtagagacggggttttgccatgttggccaggctggtcttgaactcctgactccaggtgatctgcccgcctcagcctctcaaagtgctgggattacaggcgtgagcctccacgcctggccaagttttctcataactctgtcacttactcacctgacaacagttaatatttcggcactacctctatgatcatctttgctattatgatattagaacataatcagtgacctctaagaatggctgttttagtagaaatgatgaaggctggtgccagatcataggaaaataaggaaagcacgaagttgaagaaatcagatatagtaagtttagacttactatgtttctaggatgttggcaataataaagaacaaagttgtatagcagctagaagagacaatatgatgtaataaaggaaaaggagtaaatttccttggaagaaggcaataaaaaggatcaagggcaaaagtaaaatggttagcattaaaaggaggaagtagattctagtatctttctatggtgacataggaggtatttccataaagcaagaagactgactttcccactgcacatttaaaatcactgtcaggctgggcacggtggttcatgcctgtaatcctagcattttgggaggccaaagccggaggatcgcctgagcccaggagttggagaccagccttggcaacacagtgagaccttgtctctccaaataataaaaaagaagagttagccgggcatgatggtgcaggcctgcagtcccaactactcgggaggccaagatgggaggatctcctgagcctggagagtttgaggctgcagtgagctaagattgtgccactgcactccagccttgctaacagaatgagaccctgtctcaaaaaaataaaataaaataaaataaaatcaatgtcatttcttaatctacacatcttatacatatcattgcactgggtgtgcacatttacttactggacattaatgaaggaatcagacatatagtcctcttcttctgccatgttcaacttcatatggctatagtatctacaaataaagtaataattacttttttttttagtttatcagaatggaaataaacctttctgtatctgcagccatgagctgtctctagagctctactatatattcaagtgccctttggacatctttatctgtggacatttcaaactcaacaatctaaacaactcatttctttcccctttccccagccttctacatcccctgtgtttccatgttgatgtcatcattatctccttcttcctgacctcttatgaagctgtcaagtcttcctccataaaactcctcacagacgttttctctacagttgtgaccactgctttagttcaggcactttttttttc

SEQ ID NO: 299 - DNA, 10000 bp, Homo sapien
gtcttcttcatgatgcaaatgtacatcttgacagtatcaatgtcagcatcccggttgtgatgttgtactatagtgtattagtccattttcatgctgctgagaaagacatacctgactgggcaatttataaggaaaaagaggtttaatggactcacagttccatgtggctggggaggcctcacaatcatggttgaaggcaaaaggcatgtcttacatggcggcaggcaagagagaatttgtgctttataaaacctttataaaaccatcagatcttgtgagacttattcacgatcatgagagcagcacaggaaagacccacccccatgattcaattacctcccaccaggtccctccaacaacacatgagaattgtagaagctacgattcaagatgagatttgggtgagaacacagccaaaccatatcatatagttttgaaagatgttactattaggggaaaattagtaggaatacatagcatctctctgaattatttcttgtaattatatgtgaatctacaataatctcaaaataaaaagttcaacttaaaaaatgggaatactgtaagtaataattctccaaataataaagtaagatggatcctatctcaaaatgccacatcattattatttagtgcccaaatgagacttaagacagttagaagcttcgatatacagggtgtagttactatgactcacttaaatgttattgaaatgctgtttcctgttccagtttctgcggtgaggctctaatggagtttatacttagcaaaagtgaaaagactgactttgctttatgtatgtctctctattgtcctaggtcatggttttctggtacctggtactgccattaatgtttcaggagctgtttttcccccacaagacaagagtcttattctgttgcccaagctggagtgcagtggcatgatctcagctcactgcaacctccatctcccaggttcaagtgattctcctgcctcagactcctgagtagctgggattacaggcgcatgccaccacgcccggctaatttttgtattcttagtggagataggatttcaccacgttgaccaggctggtctcgaactcttgacctcatgatctgcccgccttggcctcccaaagtgctgggattacaggcctgagtcactgtgcccagccaggagttcttatttctgcacatcatcccagcttgtttcccattaaaagctccacattgccattctttccctcctctgccccaacttaaactgcactcctaactcctaagcgaacttaacatagcagtgtataatcacataatcacatgtgaattactagtaagtttagccctccttttgaatgtcttgtattcaataaaaacaaaaataattcaaacatagtcttctgttggtagaatggctgggcatggtggcctgtaatcccagcacttcgggaggctgagacaggagaatcgcttgaagccaggagtttgagaccagcctggccgacatggtgaaaccccaactctactaaaaatagaaaaattaaccaggcaggtggcacatgtctgtattcccagctacttgggaggctgaggcacaagaatcgcttgaacccaggaggcggaggttgcagtgagctgagatcgtgccattgaactctagcctaggcaacagagtgagactctctcaaaaaaaaaaaaaaaaagtagaatgcttgggaaagatccagtatttcataagcagtggatgactgtagttgtaaatgagccaggcagggaccatgcagactctctttgacttctcccatatggattttagagaaggagaatgaggcagagctggaaaaatgcccaagtgtgtgcttgtcctcccctttctcctgtctccaactctctcccatctccctgtggtccttctctaatttgtaaagatcttaatgagaccattaattgttttccattattttgcatgtcaatgtcctttttaatgaaatgagttaatcaaatttttgctgcaaatccctacttcctcattttccgtggatttaatgcacacacttgcttggcttgttacattgtgtttttcagcaatgtgactctgtgttagctccacgatggggaagaggctagaggaaggcgaagcttgactgtacctgcaagataacacttgctgaaaaggcaccatgtcatgatctcagaaggcatgcgtgatggactctatttacctggtcccatttctctaaccagtctccttacactatgctttccacctcatctcttactgtccttttaaccactggcagagttctgcctccaggagccaagctcaaattgctgtctcttaatcaaacccaagagacttggccaactttcaccattgttagccattcggcaggttttggcccgatcacctacttccttccttgaacaactttcctcctccagtatctttgaggctgcccttcctggttctccttactgtgagtctgcatagtgtctaacttgtcatctgcctctgcatagggcactggcatttcagatggcacgtttctgagctgacattctcctgaaatgggcgccttccgcctctttcctccccacaattcatggccatccttatctccttcttgttcaggccagatgctttggtgtagtccttgactcttctttctctccctcttcacaactggtccgtaagcaaaccctgctttctcttccacaaaatagatctagaattagagcacttcttcccgcctcttatcacgactgtctggggaccctccttcacctctgacctgaattactacaatagtctccttttggtctgttctgttcatcaatttcttcttttgcacctcgtctatttattctcaacagaaaatccagagtgaagatgttaaattgtaaggcggtccagttatgtccttgctcaaaaccctcccacagcttcctgtctcactgaagtaaaagccagcccttaggatgcttacagtatcggtgccctcttgtcctgattcatcgtccttttctctgacccagtcacaccagcctccttgctcttgtggaacatgcccagcagacccctgctccatggccttgcccttgcttcccgctggctgaaacactctcttgcagacagcggtgcggccggctcctcctcccctggccacccatctagacactaaaaaccctcatccccaacccttcatctctccctttcctcttttttttaacctgtagcacttttcactggtttctgtggggtatcatatatagtatacattgtgtagtgcctttctcttccactaggctgtgaattcagtaggcagataatcatgtcttttttgttgttccattgctgtattttcagcacctagtgcctggcacataattgacatgcagtaaatatttttgcatgaactgaatgcatgattctctcctccatcctttgtttctcttcctctgttgcgtcctctcctttcttggatcttttttcttcctcagctttgtgaatctagatagctccctaaagtttttccttggtgctgtcattttttttttctttttatcttttttttttttttagatggagtcttgttcagttgctctgtcgcccaagctggagtgcagtggcgcgatctcggctcattgcaacctctgcctcctgagttcaagcaattctcctgcctcagcttcccctgggattataggcatgtgccaccttgcccagctaatttttgtattttttagtagagacagagttttgtcatgttatccaggctgatctcaaactcctggcctgaagtgatccgcccaccttggcctcccaaagtgctgggattacaggcatgaaccactttgcctagctggtcatcttgtttttattacataactttcctccatcctttcttccaccatcttccttcccttcattattgaccctccctccaatgaacctccacacccccaaacttctcatgggtttctgagactgtagttaggagtgttaagcaccccaggtcctgtagggcaagagatacaagggtacagtgtatattcacacagagacaatttcaatacagtttatcataaggacttcaggttctagcttatgttatagggataagtgtgtatgtcttcttctttccttctgtctggtgacctccttaggggcaagaactgtgcattacttatttgtattcatccaccctccatcttttcatccatgcatgcatttatcaacagctatctgtcaagcacctattgtatgccaggttccatactagggctctgggaatgtggaggttagataagaacagagaggctttaaaagcaatcagaagactttatcatttcttgttatgaagatcaggcatgcagcaagaaaaggagactactatggtagtataggcaagaaattaaggtagcttctaaaggaggtgtttatggtagatacgagtagacaaatgtgagagatatctaaaagaaggcttagatataatagtctttcaacagtaattaccgaatgaagtaacttgtcatagaaggaaagtgtggcttataagagttcaggattgtacagatctgagtttgtctccttcaagctcttctgcttaagacctgcacggctttaggcaaattacctaacctctctaagctttagtttccttagctgtcaaatggggacatgagcaaaagggatagagtttccatggacagaatgaatcaatgcttgtaaagtgattagcacaaagtctggcactaactgactctaaaatgctactacttacattataataaatgttaaataccattctttaaagagtgacaaatggttatttccacacaggttggaatatcactctattaagtagaaataaactttaaattatgtccatgttttctggtacaggtggatatagggtgaaaatgcgtacagtcctcagagagtatgaccatcagtgagctcacgctgctagaacagaagggatcattgtagaacaaagcaacagaaatgcccaggtctccctgggcacggtccattgtgcattaaacattgggcaagaaggtcacttagagtcatggtaattgcagtactgatggatggcagcaggtaactatttcttctgccagagatttttatcttttgaggaaggggagaaagcaagaggcattcagtggagcaattctggttgtctgcggaccctgtggctgttcaggtagagaggacagggatgaaagtgtggatgatgtttaaggcacccttgaggtcctctacatgagttttctttagtaaccttaagttctccactagttcctagtaaaggggcaatgtctaaatattgggtggaaacacccaaacagccattcttctgtccacatacatcatggtaaggccacagaactcttcaaagatatgactcacagctgtttaatgttccatacataatatgaactctttttgatgttcttgtttacaaagaggtaaattttttttgagatagagtctcgctctgtcgcccaggctgaagtgcagtggcaccatctcagctcactgcaacatccgccttctggtcacgccattctcctgcctcagcctcccgagtagctgggactacaggcgcccgccaccatgcctggctaattttttgcattttttttttagtagagacggggtttcaccatgttagccaggatggtctcgatctcctgacctcatgatctgcccgcctcggcctcccaaagtgctgggattgcaggcatgaaccattgcacctggccacaaagaggtaaatttttgatgggacacagtggactttcaattcagtctttaattgcttataggctaatattaacttaaaatagcccaagcagtggtatcccaatccaccctagcttgattttctctactgtcatttagcttaatttggaccttttgttgtatgtagattcatattaatttttatctgagacatcaaatcccagagtctaatcatattattttttatagaggcctttgatagtgaatatggcatttagatgagaaactctaagatcaggtacaatgatgaacacagaacagatgctcaaaaaaccctctgtgattggtttaagagaagagcttcactgaagaagattatgctgagggtgtctaacatgtgtataaaaaaatgatctgaggaagaaaatgtcaaatctccttatcatatatttattgctttcctttttgttaattagaacaaaccaatcagtttttctatgtcttgttcttcccgtatgtaaaacaccatttattggaaagcaactggctacagtattaagagaacttgtaatgcgctctgctatttctcagaatgcccatttctctgagtgggaatagtcaaagatgttgagttacccttcatattctaccattcagtaacaaagcctactaaaagaaaatgtccatgtgttattagaaattcaactttacaggaaaacattctgaattccagtatttcaaaaccctgctccattgatcttgaggctgctaccttttcatcccttcctttgaaaggaaacatcataaactggagagagagtgattcctgcagcgtggtctacatggttcaggctgaaatgtattcattaattcactgtttgtgaagcattcattccgtgccaggcaaagactgctgtgctttggaggcagtcagcctctcttgggagagacattagtgtaaacttctcagagattttaccctggaaacacttcagggcccctgagaacaaagaaccatgaggtcaccggggagacagcacatcttctgctttggatggtcaggggaaggttagaggcaggttggcaaaatggtactttctaggcagagaacaacattatgatccagactcaaagggatgggcacagagcagcctaccgcttgttaaacagtttgggcttttgcagctgggcacggtggctcaggcctgtaatcccagcactttgggaggccgaggcgggtggatcacttgaggtcgggagtttgagaccagcctggccaacgtggtgaaaccctctctctacaaaacatacaaaaattagctgtatgtagtgtcaggcacctgtaatcccagctactcaggaggctgaggtgggagaattgcttgaatctgggaggcggaggctgcagtgagcctagatcatgccactgcactccagcctgggcaacagagtgagactccatctcaagaaaaaaagaaacaaacaaaaaaaaaacgcccaaaatccaaacaaacaaaaaaagaatttgggcttttgctaaaggctgtgaaacttatttttttttggtaaagtatatataaaatttaccattttgaccatttttaggtgtacagtttagtggcatgaagtacattaatacctttgtggaaccgtctccaccatgcatctccagaactttttccatcttgcaaaactgaaactctgcacctattcgcccatagccatccatgccccctctccccagaccctggcaatcaccattctacttttctgtttctgtgaatttgactactctagtgcctcatttaagaaaaatcgtacagtatttgttattttgtaattggcttattccacttagcataatgtcctcaaggttcatccatgttgtaacatgtgtcagaatgtccttcctttagagggtgaccgtatcagtttgttctcatgctgctaataaagacatacctgagactggctaatttgtaaagaaaaacagatttcatggactcacagtcccacatgggtggggaggcctcacaatcacggcaggaggtgaaaggcacgtcttactacacggtggcaggcaagagagagaatgagaaccaagtgaagggatttccccttatcaaaccatcagctctcatgaggcttattcactaccttgagaacagtatgggggaaactgcccccatgattcagtcatctccaaccaggtccttcccacaacatgtgggaattatgggagctacaattcaagatgaaatttgggtggggacacagccaaaccatttcagtaactgatacttcattgtatttatatgtcactttttgtttatggtggtcacttgggttacttccacctttttgttattgtgaataatgctgctgtaaacgtgggtggacaaatctcccttcagtttcttgctttcaattcctttggctatgtactcagaagtgaaactgctagatcatatggtagttccatggtttatttttttggaagaaccgccatacttttgtctgctttccaagtgcagcttgcatatatatatatttattatactttaagttctagggtacatgtgcacaacgtgcaggtttgttacatatatatctatgtgccatgttggtgtgctgcacccattaactcatcatttacattaggtatatctcctattgctatcctggagagacagactaatcagcttggtttagagaactcatttcctgctctgaggagaatggaaaagaggggcaaggctggatttgagctgttgtgcaaacggattagagatggagatgtgatcagaggctgtctgttgtggaagaggacagaggatgaactgcagagatttttagagaagtacagtcaagtgcttaatgatgttggtgatctggcatcaccaataactagtctctgacatgaaagaaaattaaaaatagaataaatcctaaattactgagttaactgggaagggatggagaatggaatagcacaagaagtgagaggacgggaggaagaggggtaagaaaatgggaaagtgggaaagagagggatggggcattcaagaagaaaggaaaaaagacctggcaaaaaaggatctcatgtataagaaaagatcatgtttatgaaaagacgatcatttgggcttgtatgtaacaacaaatgcagttaaaaagatgttctttagacgtggtggagaaagtcaggacaagaaagacatagacaactagctggttactggcaccagctagatgaaccacttttgtcaatgtggcttaactgaattgactatttaactgagcacaaagatttcactggctttgggtttgaatgcaacacaaactttttgtttcagagattagagataggaattcacattctaaaagaattcatgaatgctccatcatgaaagtaagaaaattaatacccacagtttgtaacaatgggcttcatgcagttgagctgagaaaaccctaagattagctatacagtccaggagccacccatatttaggaaaacacagggctgccagcgtatgtttgtaagaacaattagaatgaagattatcttcctgaagataccaaagagcaagaggcaaagagcaccaaatgaattcaaaactatttctagtgcacatactgcaggaaacctcatttagtcatattttagaatggatatgctatgcaaacaagtataatttctgtgcaagacaattctgcatctattcagtgtgtctggatgaagtttttgaaacacactgaaaaaaatatattgaatagattttaatgtcagtgaaaggggctggattgaagtacctagactcatttgtgtgctttgctagggaaacctctttgccaagtaagttcctctaactttgaccttgagggagctaagctggttcagaggaggaggaatcagtggttttctagctgcgatcagatttaagttttccttagtccattccctacagacatttatatagtagtggtttttcttacaatagtcactgggaaacaataaccaattaagtgaaaacttcataccatttgctcctctaatgctgtttttatgtgaccttctcatttgtagtttgacatcttttggaggtgaaatatctctggctgtaaaactcttccatttgtatagaagcttgtctttaatcccaagtagccattattaactcccttgggcaatttgggtcaaccttttttatcttggtattcatgtgggaagaaggctgtttacttagcggggttt

SEQ ID NO: 300 - DNA, 201 bp, Homo sapien; identical to SEQ ID NO: 135

SEQ ID NO: 301 - DNA, 201 bp, Homo sapien; identical to SEQ ID NO: 136

SEQ ID NO: 302 - DNA, 201 bp, Homo sapien; identical to SEQ ID NO: 137

SEQ ID NO: 303 - DNA, 201 bp, Homo sapien; identical to SEQ ID NO: 138

SEQ ID NO: 304 - DNA, 201 bp, Homo sapien
acttgctgtaattggaaagccccgagaaggttgagagcacttttgttttcttcatctctgcgtccttatttcttggaacactacctggcaaaccatgggtrcaccatgcagcaagttaaggtcgccgaagtagaactgcgtattaagccagtgtctccatccaggtaagaaagaaagtgggttccatccttgcttcccctg

SEQ ID NO: 305 - DNA, 201 bp, Homo sapien; identical to SEQ ID NO: 140

SEQ ID NO: 306 - DNA, 201 bp, Homo sapien
ttcttgtttaattctttctttgagataattttacctttgatgtttcaaaagcagtgtcacatacatgaagaagttcagcaagaattagccccaaagcgtasaggtccacttcctttccatagtcttgcgaagaaatctaaagagaccaaaatagatttacctttgttatgctccttacataaatatccagccttctaaagc

SEQ ID NO: 307 - DNA, 201 bp, Homo sapien
ttctgactatatttacatctttgcctttctcttcagttaattgacatagcatttgacctttttttaatccaagtttttatgctattttaaccttacttgtytgcaaaataatacacttctcttgaaaacacttctacagtgaaaacagcccaattccttgccagtcttgtacaaaataatgcccttaacctaattactcta

SEQ ID NO: 308 - DNA, 201 bp, Homo sapien
taaattatgctaacattagatacctaaaagaaagaagaaatctgtttgcgggggggggcagtatctgaaaaaaataggagctatagaaatgatccagtcaytcaacccagctatttaattcagggtctagcggggaagactcaccctgtttggatgtgtttctctcgatggcttccaacagaaacataaagcaaaaggagt

SEQ ID NO: 309 - DNA, 201 bp, Homo sapien
ctttttctttctttttttttcttcagaggcaaggtctcaccccatctcccagcctggagtgcagtggtgtgatcatagctcactacaactttgaaattctrggctcagaggagatcctcccacctcagcctcccaggtagctgggattacaggcatgtgccaccatacctggctaattctttttatttttagtagagacag

SEQ ID NO: 310 - DNA, 201 bp, Homo sapien
gtggattcactctgcatggtccaagggaaaagatccaggactatagggtggaaatgacctaaagattagctttaaaatatcctaatatcctaatagtgttstccaaagaatgggagttagacagttccccatcccaagatagggctgaacaaccacttgaggaaatgttgcaaatatgagtccatgatctgatagggactg

SEQ ID NO: 311 - DNA, 201 bp, Homo sapien
actaactaaaacgtttaaaactgataggttacctggttgagaatattccaggatgcaagcaagcgtgctacgaatcagagctgtccactgtttttgaacgscagcctcagttttggccattgaaagtgtcacaatacttttaatcccttgaagagctgcactgactggtggaggaacctgattatctgcagactttattgc

SEQ ID NO: 312 - DNA, 201 bp, Homo sapien
tgtaattttagagatgaaaatagagtaaaatactgatgtttaacaatatctgttatttcactctatttttatctctaaaattacattattttcaacctttmttcactgattaaaatatagatcaaagcataacaaaattcaccttaaactgtcaatatttttagaatccaaacataaaatacacaaaaagcaatttttaaa

SEQ ID NO: 313 - DNA, 201 bp, Homo sapien
tatatttacattgctaaaaaattcatttaacataccactgaacatacttaacataaacttctggaaatgagttgcaactttttgttttcttcagaaaagaraagtaggtcaaagtataatttccaacagatagatgcttagatctgtgtcataactttgtagtacatatatgcacacactttttacagcagcagctaaaca

SEQ ID NO: 314 - DNA, 201 bp, Homo sapien
aaagtcaacctcatgataagagctgtgtgcacccaggaattggtgactgcaatagccatgaccatgctgagcaaggctacacacatatggtggttcataayagtactgtaatgaagagggaaacaaatggccacatagcggtcataggccatggtggtgaagagaaccatctcagctcccagagaccatgtgaacaagaag

SEQ ID NO: 315 - DNA, 201 bp, Homo sapien
cttcctatgggttttctgtaacataaaataagacataattgatcacggaaggcacaaccacattcactgcattcacaaggtttctgtcctgtgcaaatccwctgttatctcctgaggctgcacatctgaccactggctgtcccacaaggactacgttcctgtttgcgaggaggccgctgatgtttaatgatgtctgagggg

SEQ ID NO: 316 - DNA, 201 bp, Homo sapien; identical to SEQ ID NO: 151

SEQ ID NO: 317 - DNA, 201 bp, Homo sapien
tttttctgagacacggacgatactgtgtatggcacttggtcttcggatgcagtttggcttgtgttcatgctctcaaaatgtgagcagtgaatcaggttaayggaggatgcttcgggatccagtttattttcaaatcgctctgtgtaaagaatctgggacgacagagttaagggagggctgtggtaagacaccaacaagggc

SEQ ID NO: 318 - DNA, 201 bp, Homo sapien
agagctctggcttcctggagggaaaagccacgcacatttttgccatgggtgagaattctaacttgagaaaaaaaactgaggatgagcagactctaagctgmgcaggccctctctgacaagctgcttgctgagctcagggtcacagatctcccttaatcaaaacaacactgggaaatccatgaggctgaaacttccccaggc

SEQ ID NO: 319 - DNA, 201 bp, Homo sapien
tgccgagtgaagttgctcttttccctggaaagttggtttatcagagcctccttctcttcaagcctccgtaggaactcgcctacagaaagatttcacaaaastacataattacagtcttcctatctattgcctccttcacttgacttactgactttaagggtagccagaatgactcctacccacatatttttgatatttagg

SEQ ID NO: 320 - DNA, 201 bp, Homo sapien
agcactttaccaactcagaggagttaatgcccatgaggaaagcagctttgtcagcatctggtcatcagaaatagaagaaaaggaaggagagaggaaaacaytgttaagattcattccattatagccaaactaactacccagaggacagaaagatagtgtgtttacatcagcgtagcaaagtagattgtagttttcaaataa

SEQ ID NO: 321 - DNA, 201 bp, Homo sapien
tccagctgagccaaactggatcctcctacctcctccagcctctcattcaagtcagccaggtcttgggtgaggtcagctctctccctttccatcttggctcragtggtcctttcagcttctagtttctctttcaaatcctttatttgagtctgtagcaagaaataattttgacttttactaagcacttgtagcaagagcttt

SEQ ID NO: 322 - DNA, 201 bp, Homo sapien
aagtcagccaggtcttgggtgaggtcagctctctccctttccatcttggctcgagtggtcctttcagcttctagtttctctttcaaatcctttatttgagyctgtagcaagaaataattttgacttttactaagcacttgtagcaagagctttactctatttttttttaatcacaaagctaacatgaaacttttggttccc

SEQ ID NO: 323 - DNA, 201 bp, Homo sapien
aataaataacgcaatgttacaaatacatgtccaagttgatgaagtatttatggatgtggctgaggacagaagtggagaaaatgcgaatagaatgtgttgcyatctagtggtactaagtggtttgagcattatggccttcctgtcattctcacccttgacccacgtgatgatcgactgaatacacaaagatgcctctgtgtt

SEQ ID NO: 324 - DNA, 201 bp, Homo sapien
tattgttatttgtagagaagatctccaatggcattgtgcatatgagggtgagccaatgtacttattcttatgatagaagcatgaaacatgggattgtatayaagtggaaagaaacacaactataattcacttgcaaattatagtttgattgtatacttcctttttactgcattccttttagtatttatgtgttccattaat

SEQ ID NO: 325 - DNA, 201 bp, Homo sapien
tggaacattaagaatccttctgatgaggactcacaagaagaggagagctgtagagagagaattaatcttcttagagatagttggatggctgtgattacaaygctggtagtaaaacagacagtaaaggcaattctgctgaggtcttaaatggaaatggggaatatcctattggaaactggaagacagaccatccttgttaca

SEQ ID NO: 326 - DNA, 201 bp, Homo sapien
aaacacttagtggggaataaaaattatcagaaatcctttctcataggagacccaaaccctgacagggacattttaaaaaatgaagtaaatgaactctgtcrattttaattcctggtgttcatgaataatgcagagctggaaatgtagatagcaatggatttgagggaggcagccaggattttaacactggctttgctggta

SEQ ID NO: 327 - DNA, 201 bp, Homo sapien
agagaccaggtctcctctacctaattttcttcttccccaaatcctctcctctctatgaatgctttttctctagctgatcctcatctctctctaggctagtkattttgcatcatattggatcccactggtgcattatcatgtatgatatgcatggcaaatgatttgttaccaacagcaattaagtactatagaccagcggtc

SEQ ID NO: 328 - DNA, 201 bp, Homo sapien
ttttttctttctttttttttttttttaggagaaagggagttaggaagtgctttgcagaaaggtaatctagattgtcacagctcaagtttgaaaaagacacytgtaatcagtcaaagataagtttagcctcaaatgttagtcctaggctggagatctggaaatgcaggaggtagctaagaaggctccctaaaaggttcagta

SEQ ID NO: 329 - DNA, 201 bp, Homo sapien
atcaaatgtgcagtgaaagcctgcattagagatgatggagtggggcaactgacaagagagtttcgtttggatgccacaggtgatgcacacaaacaccattmagataaaatgtgcagggctttccgcccccatttcccatcctctgatagggcctaagtcctgacatggatcaacatagcaggcagggacaattctcccgaa

SEQ ID NO: 330 - DNA, 201 bp, Homo sapien
tatcaaggcccagggtttttgcccttcatcaaaaaaattcttttagacactgactcagaacctcttaagtagatcagaattcctcgccacagtcagtcctrtagaagaaaatgccagtgagtgagagcaaagataactcaaagcacatagaaggccaaatttggcttgacaccctcattaaaaaattgacccccttgagag

SEQ ID NO: 331 - DNA, 201 bp, Homo sapien
gagcacattgtggaaggctttggctatctcgctaaggagtttagattttattctatatttcaaaacattcttttaaggcaaaacacattttttcaaacaawctccaacataggtctcttgactgagacattttcttccaacaaggtggggaaacagggaaaagatttagccccctacctaaaacaacttaagaaaaaagca

SEQ ID NO: 332 - DNA, 201 bp, Homo sapien
tgttcagttcacagtgcagcgaaaactagaaaattctgaagaatcaaacttaccttcaaagctttcatttatgactccactgttgtttgcttcatctctgsactgataaatgctatttaagaaaaaatttctgaataactgaagttggttctgaattctatgaaaagtaggtctttggtcgggttcttgagcccagcactg

SEQ ID NO: 333 - DNA, 201 bp, Homo sapien
ttaccttcaaagctttcatttatgactccactgttgtttgcttcatctctgcactgataaatgctatttaagaaaaaatttctgaataactgaagttggtyctgaattctatgaaaagtaggtctttggtcgggttcttgagcccagcactgggtcattaaattccacctaaatatatggggaaagatgggaaagtaaata

SEQ ID NO: 334 - DNA, 201 bp, Homo sapien
taagaaatgtgtgcacaccatacctccatgaggatgagtcctgtaactgggacttggaggggagtagagctgcagctgcgctgtgaagatccaaaccactyggaaaatgtactcagtgaaggggtgcaggggcttgaccacataggacggtctggacacagtctagatcaaggagtgatcaataatcagcattatagaatc

SEQ ID NO: 335 - DNA, 201 bp, Homo sapien
cctgaatttaattaaattcacctaaagtaagatgcatagataggctcatctggtactacaatgtttcattagcaagcaagtttctcaaagattatttattsccaatggaagagaattcatctttacaaggctaacacatacccattgtatgaatcagccacaattttttgaggtgcactaatagagggtggagtaatttcc

SEQ ID NO: 336 - DNA, 201 bp, Homo sapien
taagactttcctacccacctcagagctctgtgaggatcaaatgaaatgatgtttctgacacatgataggtatgtagtaaatagttaataaaggagtgatayataaaaatgtgttttgtacactttaaggtgatacacacatgtaatgatatggctagtatcttttttaaaatatcttttccccaaaacattaaatttagat

SEQ ID NO: 337 - DNA, 201 bp, Homo sapien
gatataggtgaaggtttcataggcttgtctactcactctatgccactgctgctcaggtataactctctagtatctattatcatttgctgtgcatgtgtttrtctccctcctgttttatgaactccatcagagaaagcatctcttcttattccttgttaaatcttcccatatctagtatagaactggcatacagtaagtggt

SEQ ID NO: 338 - DNA, 200 bp, Homo sapien
gaaagacatgaggcaaggttcttacaggacctggaaataaggtaatcatccagaaatgaaacccgtaaaaaccaatgcctgaagtataaatttgccatattagaggtgaagcagaagggctttgggaccaatcaatgcaataaattagcctatagatgtgaagttagcctacggatgtgaagcagaagggctttgggacc

SEQ ID NO: 339 - DNA, 201 bp, Homo sapien
caggatttacattcattgtaaataacagaacagcaatttctcttttcctaaaattttatttctgtcatggcccagaaatgcttgtttctttctaaattgtwatagtttgatgatattccctgttaaattcttcctgcatcattactttgaatatttgtctgcttctctattgttgggaatattacttagaattttaattct

SEQ ID NO: 340 - DNA, 201 bp, Homo sapien
cagttcacagtgcagcgaaaactagaaaattctgaagaatcaaacttaccttcaaagctttcatttatgactccactgttgtttgcttcatctctgcactkataaatgctatttaagaaaaaatttctgaataactgaagttggttctgaattctatgaaaagtaggtctttggtcgggttcttgagcccagcactgggtc

SEQ ID NO: 341 - DNA, 201 bp, Homo sapien
aatcctaaatgaagactcttgaacagaatctggaataaccttaggggtaaaggaaaagttccctacaggatgaaacaaaaaaaagaaataggagaaaaaawtggggattattgaccaatatagaaatcatagaaaatcaatagcaattactaataattagaactgaaacaaaatttttcttttctttaacatatcctgaaa

SEQ ID NO: 342 - DNA, 201 bp, Homo sapien
gctgtgggttgcagaattcggtgcaaggtgtgactgataatactgtagtagaacatctggtagccaaaattggaaacttctgtccaatacaagcgactatrgaggaaaaaaaagtccccccaacttaatgagtaaaatacatcatttcaaatattggtttctaatgcagagcaactattgctaatgactgtgagggacaaa

SEQ ID NO: 343 - DNA, 201 bp, Homo sapien
aaaattttattcagagaaatgtctcattaagtaaatgcttagaaaatgacaaggccttaatagtacctagaatggcttaagggtatgtttgcctaatcctrtgtgatcttcacataggcaagtatatatgtagagccccccaaaaggatggagttgctgtgccagttataattcccaagtgttctgccattggcattctaa

SEQ ID NO: 344 - DNA, 201 bp, Homo sapien
ctcaacaaccttgccccagctcagcttattattttcagccatgagaattggctcggtggaggtggtccaccccaggccagagtgggttatgcatgacacamacatattgtcagacactggttgtctctgtgttgtcttcagtatctttgcctttagggcagaagaaaggtccttaaaggaatgacattggaaggctgcaga

SEQ ID NO: 345 - DNA, 201 bp, Homo sapien
taacaatcaaataggatttatgttcatatgcccctaaataacccagaaatgacatcacatgatgtatcactattctcaacaaccttgccccagctcagctyattattttcagccatgagaattggctcggtggaggtggtccaccccaggccagagtgggttatgcatgacacacacatattgtcagacactggttgtctc

SEQ ID NO: 346 - DNA, 201 bp, Homo sapien
ttatcatttctagtcacattgcaaaatctaagcacaaatccattttatcctaatggaaaaaaagagccactgaagacctcagtgatcgcatttgaatgatygattagtgggtaaagttcattatcctcagaatgagtcattttgtgtaagtgtcaacaacaaagttacatttcataggaccgtagacctttacacatgaaa

SEQ ID NO: 347 - DNA, 201 bp, Homo sapien
ttgctgacctctgtgctagatactgttctaagtgctctactaatgtgttttaattttatctgtacaacagttccattaaaagatataataaatattccccrtttccaggtgtggaaactgagacacagagtggtttagtaacttgcccagggtcattctattaacaaatggcaagtatttgaatccgtgcaggctgactcc

SEQ ID NO: 348 - DNA, 201 bp, Homo sapien
aggtaaaaatgtattctggcaattctcagccttttaggagttgaatcatgtccttgctccatgctgagagagatctattgatttttttttttcagttaaaragaaatcaggttaaccttgtttggttatttacaatgagatacactagagtttctacattacaaattaagtctatttcatctattttaaaaaggagattct

SEQ ID NO: 349 - DNA, 201 bp, Homo sapien
aattttttaaaataaaagtgtaaaatttatttttaaaatatctgacaatgctaatgtggaagatgtagagataccgacaagatcaggacagggggataagyttgaggacacagatcaaggagataattcatgtggtccctttcactctctaattttcatttaagacatcacaggaagagttctgccttcactccataatgt

SEQ ID NO: 350 - DNA, 201 bp, Homo sapien
gaatcattttttatgcactactatcaaatttggtcagatgtgtgtgtatctgatctccctgtaaacatcgcagagactattaagttaaatcagaaacaagyggtaattccaatcttcttctagctggaagatttaaataatacaaaaacattcaccagtagaacatctaaccaaggtgcccagctcttaatcatcttttgg

SEQ ID NO: 351 - DNA, 201 bp, Homo sapien
tctaaacaaatttgcaggtccttcaagtttgttaaaatttacctgggctggttgttttggctccagaaaaatactcattatacttgaagtatctcatttgsctaagtagaggttccaattcctccactcaccatgcaaactctttacaactcttctcctcaagtttttttttttttttttttcaaaatagcacaggactca

SEQ ID NO: 352 - DNA, 201 bp, Homo sapien
atagtgagtagaaacaatgtgagactattaacaaggtttactctaatgagggttatgacgcatggccaaggcatgtgcagccctttccaatctgtcgcttrgcagtttgtgttgaagaagttacatgatcagagttttatgctcatataatggatccaaagtcacccaaaatatgtagtaagacgcatagacaagtagatg

SEQ ID NO: 353 - DNA, 201 bp, Homo sapien
catccttcctctggactcccacagaacatggatttcttctcaataacaacatagaatgctcatttcctggattctggcagaagatgtaatacaaaatcatyttctcaccaaatccttaaaaataagcttatttgtaagaaaaaaatgctggagaacctactacagaatctacagcccatgaattcctttagattacctaaa

SEQ ID NO: 354 - DNA, 201 bp, Homo sapien
ccctgacttcattactaaacaatcttgtactccataaatttattttaaaaaaaagaggagtgatatagttaagaaaatgtgctttcagtgccaagcaagcwaaaccatgttttgcctgtctttcagatatgtctatattcaattcaacccagttactgatgtttttctatcttaggaacaaaagatttaattttatgtatt

SEQ ID NO: 355 - DNA, 201 bp, Homo sapien
ttagaatagttgcctgacagggagggaggaagttgaagaggagaggaatatggggataaaatggctaaacaaacaaacaagacaggagccctgcataggcyaatgatgataatgtaccgtaagcaaagagtctataattaactctgtacttgaggtccaaactggtgtgtggggggagaagagaaggagaacagaccttat

SEQ ID NO: 356 - DNA, 201 bp, Homo sapien
taagtgaatcaaaacaaaggctttgatttcttatttaagagtggcttttaacattactacgtttattagataacacctttcttttgaaaagctgacattawtttaacagttattattccaaataaatagatggataagtagatggtgggaaaatatctactcaacactcaactactcaaggtgaaggtctcctgtgagggt

SEQ ID NO: 357 - DNA, 201 bp, Homo sapien
gccaccgctcccggcctcatctcacttttaaaatatgtttttttgtaaattaaatttgttatcactatttgttgaattaggtattttttccccaataatartttaaataaatacatgaaaatgctcacctgagcgttggttcttggcaggaacatggcatgctccaaaagcatgattcaaggcaactaagtgaagagacta

SEQ ID NO: 358 - DNA, 201 bp, Homo sapien
aatcattgcactgtacaaatcacacaataaaattcacagtttatgggaaaagtaggatgaggggcataacactaaaaacttcatcagtgacattttttttwaaaaagataaaaacttaataaaaatggtagcacaggcttactcatgttaaatggtactacatattataatagtatatattaatacttagtgatttgatac

SEQ ID NO: 359 - DNA, 201 bp, Homo sapien
cttggaacaaatataaattatcagtcacactccagagttactgaatctgaaatgttgagcctgtgtcaagcttgcctaaaggtagtggtaactctggcctmtttagcaacatgagccagtgaattttgttgttgtttaaacctgttgttatcaaacatagctgcatattacaatgatctgtggagttttttaaaaatctca

SEQ ID NO: 360 - DNA, 201 bp, Homo sapien
tcataaaagaagatatataaatggctgataacaaatgaaaaagtgatcaaaattgatagtcatcagggaagtgctggttaaaatcacaatatttactgctycccacaccaaagaatggtgaatataataaagattgtcaaagccaactgttgagaggatatggaagaaccacaattttcatacattttttatgggaatgta

SEQ ID NO: 361 - DNA, 201 bp, Homo sapien
accgtcatccaccagtgtcaaggtaatctggtttttggcttttccatcttggagttgagcggtgtacgaccctttgtcctcctcagacaagttctggatgrtcacttccaccaggcccttctctcggtcaaaattgattttgcggttctgaaaaggacaaactccagagtccttttccctgttctgggaactttgttgtgg

SEQ ID NO: 362 - DNA, 201 bp, Homo sapien
tggatgctgcctgcctccctgtcctccccaggtggggcaagatcatctaccttggcaagcacagtggagcatccagacggccagaggttcagaaagggctkcagcagaccgactcggtgactggctcatgggagagcagcacagcatccctggtcctgcaaatgcttaaaacagagagaatatgagggcaggcagatgccc

SEQ ID NO: 363 - DNA, 201 bp, Homo sapien
agcgggaagtgtgtgtggcccgtcctggcccagggactcagcctcacctaccatgtcattctcgaaccacaggaagtaggagcagtagaaatccccctccyggaacagcagcgtggtgtagcccttctgcaggtatctgcgcgccagctggatcagagaccagacctggggaaaagacagcaagcatcaccactctcccag

SEQ ID NO: 364 - DNA, 201 bp, Homo sapien
gcctgaggcctcttccactcactaaatttgcatgaaggtgtctttgacaggtccagttcatctcggcaaagagcattcaggcccacccatgtccagcaccsttggagggctcctggccaggagaagcgtcctcaggccagccacggccagcaagagccttcagaggccagcctggggtccggaattggacctgaagccagc

SEQ ID NO: 365 - DNA, 201 bp, Homo sapien
gaagagtttctgtgtggtacagacttctggaagctgcccaagattggaatatggcttctgcccactgtcaacagcttgaagctggaggaggtcacagctgyccaggatgaccttcccaccttccctgcaagtgaaggggttctctgacaggtggactttagagctcttcataagtgcgtccctgtccttgtaccatctaaa

SEQ ID NO: 366 - DNA, 201 bp, Homo sapien; identical to SEQ ID NO: 182

SEQ ID NO: 367 - DNA, 201 bp, Homo sapien; identical to SEQ ID NO: 184

SEQ ID NO: 368 - DNA, 201 bp, Homo sapien
gggcatctctgactccacagaagtgcttttggtagtgggcagatcttcagccagctctgcctctggctctagcatatcctttgagggagacttggttgtcstcatgcgcgggtgatggagcaccagaggctgcttcggcacctttgggatttcgcttttcacctgtcatggagaagggccagaatgaatttgcttcctaat

SEQ ID NO: 369 - DNA, 201 bp, Homo sapien
gcatggccacacaattgctgccttggttgtgaggaaccgtgcaagtcccacatcatgaccatcctgtcacgagaggcactgaagaactggctggatttggraatacaggctacctgctcagggaaaaaacaacaacactgaaatagctctggtatgctagttggactggactttaaattgggggaaagatgagtctgcata

SEQ ID NO: 370 - DNA, 201 bp, Homo sapien; identical to SEQ ID NO: 192

SEQ ID NO: 371 - DNA, 201 bp, Homo sapien
gaacggctgcagggttgtcagtgaagatgtagtagtgcacccggtacccacgcatgaagaactcctcggctgactccaggaaggactggatgaaatgagtktacctagtgatgatcacccggtcacccactgctacaccagcagcctgccagggtccccactgtgtgctggggtcagccaggctggggtccacttaccagc

SEQ ID NO: 372 - DNA, 201 bp, Homo sapien
cagccctggcttctggccacttttgccccggctcctcttatacacacaggaaacactgggctgaggggctgccttgaggggcaacagttgttgcaaccttygggggcagtaggacaccagcttccgaggccactcaggggagcagaagagagggctgctggccagcatgacgtaggagaacatacctaggaaagcagggag

SEQ ID NO: 373 - DNA, 201 bp, Homo sapien
aagtcacctcctgggccagctgctccagggaaggacggcctaatatcagatttcgaagtgagatacaagtcatcaggaagctgaaaaacaggaaaaagccraccaagttcaaactcctgtttcaccagaagaatttcagctaaagcccttagaaggcacctggtcctcactcctcccacacaggcatatatgggaatctcc

SEQ ID NO: 374 - DNA, 201 bp, Homo sapien
aacagtaaattgtcagcatcagacatctcaccccagggttaaggtagcccagttcgccagtgcggccatcacggtaggtgatcttcacgtgctggtgggarcgggagtgcaccatcatgtcccaggaatagccatacagcccatttgtccagttgttatagccctgggaaggcagcacagaggggaatcagctcaatgctt

SEQ ID NO: 375 - DNA, 201 bp, Homo sapien
cttataatcttgttccagtgggaggagccactgggtcactcactctgccttttccccaacagtctgagcacttcaagacgacatcgcagaaggtggctcgraaattctggtggaagaacgtgaagatgattgtccttatctgcgtgattgtttttatcatcatcctcttcattgtgctctttgccactggtgccttctctt

SEQ ID NO: 376 - DNA, 201 bp, Homo sapien; identical to SEQ ID NO: 197

SEQ ID NO: 377 - DNA, 201 bp, Homo sapien; identical to SEQ ID NO: 202

SEQ ID NO: 378 - DNA, 201 bp, Homo sapien
ggtaggtctcctccctgtgtgttccagccaggtagcttggttacccattctttgctgccttcttaggccagtgggaaaccttagggcagctgtgcattgaytgggtagacgccattctggagcaggtgagaaaagaatcagctttgtgggagggtggggtcctgggaagatcccaccttgggacagcttagaggaagctga

SEQ ID NO: 379 - DNA, 201 bp, Homo sapien
tgcggaacctgcaaagtgaggtggagggagttaagaatattatgacccagaatgtggagcggatcctggcccggggggaaaacttggaacatctccgcaayaagacagaggatctggaagccacagtgagacagggagcccactgggggctggaggaaaacagggagggagggaatttctttttggtggggcaaaatggac

SEQ ID NO: 380 - DNA, 201 bp, Homo sapien
agaaaacaaaacaaaataaacaaacaaaaaaagtgtttgttggagaagctgacatttcctccttggaactgatttcttctggaatgggtcaagaatgttcsttcccttctgaatgtccctgttattgttcttctgtcttgataaacactgtcaaggaagatcagattttctctggcctggagccaggttagtggaaaaatc

SEQ ID NO: 381 - DNA, 201 bp, Homo sapien
tctaactcttggtctcaagtgatccgcccgctgcagcctcccaaagtactgggattacaggcatgaaccactgcacccagcctattcttaatcctattttrcaaatgaagtgacttgcccaaaactgcacagccaggggtagtagtgtagaagagcaggaggtcagatgtcaccctagtctttttatcacacagggaattg

SEQ ID NO: 382 - DNA, 201 bp, Homo sapien; identical to SEQ ID NO: 204

SEQ ID NO: 383 - DNA, 201 bp, Homo sapien
tttgcctttgcaaccttgggcaaaaaatacatcaaaacattctgtgtcttttaaaacagggaaacagtaaatggcttaccttctttggattttctgcacayctcttgacactccgcgttactctctgcacagattcgctctccaaagtgcttgctgcaggctggctttttgtctttcttgatctcaggcacatggagtctg

SEQ ID NO: 384 - DNA, 201 bp, Homo sapien
tccctctacatctgctttcctgatacttctcttgggtcgttgctttgtgcttgttggggtgtccactgggtctgactgtggagagtcgcagggtattttartggttttaccagcagccactaattcctcggtgtgaccaggagtctggaagagctctttaaagccagccaggtcttctagagcctgggccttttccttagg

SEQ ID NO: 385 - DNA, 201 bp, Homo sapien; identical to SEQ ID NO: 212

SEQ ID NO: 386 - DNA, 201 bp, Homo sapien; identical to SEQ ID NO: 213

SEQ ID NO: 387 - DNA, 201 bp, Homo sapien
acatttctgacttcagagaatatctcaactacctgtaactgcaggaccaacatctcagatatttttgcctcacattctctgggttttggttcttaccacaytgccttcctggagacaataaagaatcttgtcttgtgcttcagtcacacttagtgctggagaaattttactggatgagaacctcagcctagacctggtaca

SEQ ID NO: 388 - DNA, 201 bp, Homo sapien
actcatctctgtgccccaacacagcacctccaacactggagttcaacacatggcatgctcagctgaatggaacagaaatcaaagttacaaactccaactaycccaagtaccaagtggatgccaccctggctcccttctccatgggagcagagacctcgccactcacctggatcgctgttgctggggtcttgggctggcacg

SEQ ID NO: 389 - DNA, 201 bp, Homo sapien
aaaggaaacttcttcattacattgcctatcagtgcagttaagtaaaaaggcacatggaactatatgaacagatgccattaacaggtttttgcttttacatrtcatctttcccatttgagcattaattactcagtattttctcatcagttttcagaaagtttttcgaggataaacttgtagagggatttggggagaggaagc

SEQ ID NO: 390 - DNA, 201 bp, Homo sapien
caaagcctgtttctcagcagccagtttctgctcttgggtccttacgggccgtggaaacttaggcaaaactccaccaggccagatggactcctgaagaagcmggaggtactgcacccagcgctgtggacttgttaaattagctacctgcacctctagccacctgtggtagaagagagacgaaagcttagataaagctgaagg

SEQ ID NO: 391 - DNA, 201 bp, Homo sapien
atgaccatcaacttagcagcttgcagcaaacatgtttattctcttacatttctgaaagtcaggagtctaagatggattgagagggcttgttcctgttggargctctaagggaaaatctcttttttgtcctttccagcttctacaggctgcctgtgatctttggcttatggcaccacatgctccaacctctgcttctgtggt

SEQ ID NO: 392 - DNA, 201 bp, Homo sapien
aggtagtcaataaaagctttctgatactctcaaggcatttttcatccctgtaacccctgtaacagagaatctatcttctcttacggctgcagattccctgracactattcagcatcacatccaccttctctgcaacttgagattctgatgtgagggagaattcagcagtcttacctttgaactagggtcccaaagataaga

SEQ ID NO: 393 - DNA, 201 bp, Homo sapien
cattttcttgtctacaaaggcagggtgagcgactgctgccctgtgatttctggcactcccagtggaaaggaagcagaggggccaagttatggcagagtgcrcccagttaggccttcgactacaaaagtatcatggtttcccttcctccccagttaccattctttccctggttcccatccccttccacatccagcagtgtgg

SEQ ID NO: 394 - DNA, 201 bp, Homo sapien
ttctttccctggttcccatccccttccacatccagcagtgtgggctaaccttcctttcctcatcctgggaaaacacatcttgctccagtgcaaagttagaytggacaaacagccggtgtggagggggctgtgggaggtacggcttgccaggacaacttggctgaatgggttcctgaaacaaggcatctccaaatgctccct

SEQ ID NO: 395 - DNA, 201 bp, Homo sapien
caagcaaacaataaaaccttcctggatcagcacaggcccaattcttccctgccttttatcaccctgtcagctgggagtatcttttctacctgtggctctcyaccaattgttactctcttgttgtctgaacctgctagccaaacttggcaggtcgttttcaaagccagatgagttctgattgttcccttggcaatatccatt

SEQ ID NO: 396 - DNA, 101 bp, Homo sapien
matttttttcaaagtgatatggtcagaagtgaggttcaaggctgttgaggcctccccttcacccacctcatttaagactgacatagctgtgtgggtcatgg

SEQ ID NO: 397 - DNA, 201 bp, Homo sapien
tggtgtagattcaggacattatccattaaacaaaatgtttttgcccatttcacacctgataaaagttatacttcttttctctctgatgccgttcccaggcstctgtcttcctgccatggccccttcttgtgtttatagacagtttcccctgtcagctctcagctctaggcttctgtcctgtaactatccagacccaagtta

SEQ ID NO: 398 - DNA, 201 bp, Homo sapien
agggtgggagagaaaggaggtcttggaggtgatggtgtagattcaggacattatccattaaacaaaatgtttttgcccatttcacacctgataaaagttayacttcttttctctctgatgccgttcccaggcctctgtcttcctgccatggccccttcttgtgtttatagacagtttcccctgtcagctctcagctctagg

SEQ ID NO: 399 - DNA, 201 bp, Homo sapien
tttggagacacttgtttcgtatgtatgtacatatatatgtatatatcagatctgcgtgcatgcatatgtgtgtatgcgcctgtgcctatgtgcatgctcayagtgggctgcaacgtacaatgcattttttactgtaggttgaagttttaaaaaaagtttgaaaaacactcatgcagtgtcaagaattaggagttccgagag

SEQ ID NO: 400 - DNA, 201 bp, Homo sapien
tcaaactagatgctagttttgccaaccaaacatgtctccaaacattgcggcatgtcccctgaggacaaaattgctccagttgagaattactgccttagacycagggacttttggatataattgtatcaggctactttcacagtcattttaaacctcatggttgtagcgcaatgtttttcgacctgtgggctggacatcatt

SEQ ID NO: 401 - DNA, 201 bp, Homo sapien
tgccagacaggggagaagaaaggatgtggagatcagggcttgtcagtagctgggactgcacatccactccatgttcaagggaacctggtctgaaatagccrcagataggggaatgaagcaatgactaaaaaggagacagtttaatactagggcttaagatggcacttcaaggttagtagaaggtcatttcccatcaaaaca

SEQ ID NO: 402 - DNA, 201 bp, Homo sapien
gaagatgagtaacaataagaatcgtgttatttatggagcgttcactatgtgccatctaccgtacaagaagttttacagaacagaacactaaaagggcctcsgtctctgggtgagcctgcacctataccttcccaactctcctctggcaaggctgcacctattatctttctagctctcctctgatgggaagcattataacct

SEQ ID NO: 403 - DNA, 201 bp, Homo sapien
tcattcctctacctcacagcttcttttcccaaaggaaacaggatctactcaccagcaacaatcccaacatcacaaaaggaacagggaaataaacgtgcatrcaactgggacacacagacccctgtcacctgctacaaatggagcagaagtgggagagaagtgagccaccgagaacctaggccttcttagctgtagcctact

SEQ ID NO: 404 - DNA, 201 bp, Homo sapien
tttttaagctgtaattcaatttctaagacacactttattatcactcactatgcctttcttaagttgtaaatggctgtatattcagggatttggtatacttwgccttgcccaacacctggatggaaccaactgccactggttcttgagagcaatgaagaaggtggagatttcttcatccaaatatctttcctctccctttca

SEQ ID NO: 405 - DNA, 201 bp, Homo sapien
caatccaagggcaattatgctccaaccttaagataccaaatacagttcaaaggaaaagagaaagaaaaggaagatcaagttaaagcttctatcatcctaartacaccttcagtaaattagaagtattgacttattttattaccctgagagcagggttttcaacgttggtactactgatattttggactgcgaaatctttgt

SEQ ID NO: 406 - DNA, 201 bp, Homo sapien
ttcaaaggaaaagagaaagaaaaggaagatcaagttaaagcttctatcatcctaagtacaccttcagtaaattagaagtattgacttattttattaccctkagagcagggttttcaacgttggtactactgatattttggactgcgaaatctttgtcataggggctttcctgtgcattataaaacattccacaacatcctt

SEQ ID NO: 407 - DNA, 201 bp, Homo sapien
tcaagttaaagcttctatcatcctaagtacaccttcagtaaattagaagtattgacttattttattaccctgagagcagggttttcaacgttggtactacygatattttggactgcgaaatctttgtcataggggctttcctgtgcattataaaacattccacaacatccttgcccctcctcccctcaaactagatgctag

SEQ ID NO: 408 - DNA, 201 bp, Homo sapien
atgaagaggagaaagggaagaagatactaaaatcataaaacagaaaatattcataagatccacaacaatattctaaacaaaaatgcctggtgcagtctaartataaggaaaataacaggtccattccttccagcctatttatctattggctgtacctctatagacaatccaagggcaattatgctccaaccttaagatacc

SEQ ID NO: 409 - DNA, 201 bp, Homo sapien
agagttttggctggtgcaatcagacagtgcttcttgaaaatggaacttgaattggtccttatgggcagaggtagcctacttgcccagctggagaagagaargtaatctaccacgtggaaggaaggacatgaacaaaaaaatgaaagcaggaaggaacatgctggtttgggcagaataaaaaatccctagatttttttggaa

SEQ ID NO: 410 - DNA, 201 bp, Homo sapien
ggaaataagaagctattccttgtaagtttgctaatcttatctgttcagaataataaaagttctctgtcaaagacttaggaagggagatttcatcccccagscttgctagtcctactctttgtgcattcttaagacaggaggcaagtgctttccattctccttggaaaaactgaggctgaatatgcagcttgtcatgcagtt

SEQ ID NO: 411 - DNA, 201 bp, Homo sapien
agcaactgcttgtaggcaaagtctgttacatgcctgtcactgggctatgcacccgaggatggaggcactagctgaggcttacgagttagaatagataaggwgaaaattgtctgccatggtatatgctggaaaaactctgggaaacaagacaatctgcctccaagggattaacagcccagtagggaagacagaccaacaggc

SEQ ID NO: 412 - DNA, 201 bp, Homo sapien
tacatttatatctagccacaaacagtttttgtttttgattagtaatgtacacatcacagatataaaattaatatgtattaaaaaatggaaggattcttaargaaggaacttcaaaaaatcatctgttcaaccttagtggtttttccaatctcaccaactctacatatgaaagcattgggcaccaaaaggaaatattttaca

SEQ ID NO: 413 - DNA, 201 bp, Homo sapien
gccaggagtaattctctgcatcctgtcacatgcttgtttctgcctccaagaaagcagagttaaaatggactttcagaccagagacaggtgaggatgacagkgaggcagtgcaaaggctccgcaagtctgaaaatagcatagtgtgtctgccaaggtctgcgggtgcccaaatttcccccaccgcttcacggtggccttggc

SEQ ID NO: 414 - DNA, 201 bp, Homo sapien
tggcctcccaaagtgttgagattataggtgtgagccgctgtgcccggcctagaagaggattcttgaaggacttctgggaaatggttccttcattccttagmagaaaacacagaagagatgctcctgttcttttatgaatgttatctctgggtgtgatgcctgaaactgcagcagcaggaaggcaggcagtctgagagcaca

SEQ ID NO: 415 - DNA, 201 bp, Homo sapien
ctggattattctaggactcttcacccagcatttctggtccctttatgaaattccaaccttactatcttgtctacctgatatgaagcaaagacaactcctgrtcttgacatgaatcacagctttgctataaggccagggctcatggtgaacatctttacatggtctgtgatacacaggccagggtacgctcttggagcattc

SEQ ID NO: 416 - DNA, 201 bp, Homo sapien
cgacctgtgggctggacatcattagaggtcatatcatctgttttgttgtttgtgataacataaaaaggcatctcatgtttggagacacttgtttcgtatgyatgtacatatatatgtatatatcagatctgcgtgcatgcatatgtgtgtatgcgcctgtgcctatgtgcatgctcacagtgggctgcaacgtacaatgca

SEQ ID NO: 417 - DNA, 201 bp, Homo sapien
gtgcccctctgttaagtatagtcttgcccttctgtatttgtgcaattaaaaaaaaatctaaattatagttcatcttgttggctttagattatcattctaarttttctaaatgtttttgaatcttaattttcatcatctagagttttaactactcctctaagattagaattacttgcaaattttctgatgaaaaaattgatc

SEQ ID NO: 418 - DNA, 201 bp, Homo sapien
aacccataatggtttctagggttccccattgcccttcccaaatgttcacaaacatctatttcgtcatctgcttcagaaatttccagaaataaatgttgggrtcaagaacctttaaccattttttaaaaaggcaagatatctgtgcatctctaacccatatggacaaatggcaatgtttcttaatgaccttaggtctttaat

SEQ ID NO: 419 - DNA, 201 bp, Homo sapien
tttacttcctccaggacctaacaactggtgttgtgtgctatgagcaaaggaagagcagtagctggaaatgaataacctgggtaggacacaggaagactcaraaatgttctaggctatgcaaatcaaaaccatgagatagtaatatcacctaataccttttaagatgccattatgaaaaaacaaaacattacaagtgttgga

SEQ ID NO: 420 - DNA, 201 bp, Homo sapien
tttgaatactgtttatcaattccattgctcatttcttgctccttgaatctgcttgtcaaatctaagttattttctttgtgctgagacaaaattgaggaagytgataaactagaacttttgttctgtgtctcctgatacgtactttggatgatttcactaggattgttctgacactgatttcttgtttgatgtttcaaagaa

SEQ ID NO: 421 - DNA, 201 bp, Homo sapien
tgcacaagggcaatatcatcatgaagcccaggactgctataattttcatgaaaaataatgttttggactttccgtgtcatatatggtttatttactacaaytccaaagttgacagtccaatcttttgaattatttttcctagaggacacaatgtaattagaatacactcagttgctgggtcacaacactgttcttagtggt

SEQ ID NO: 422 - DNA, 201 bp, Homo sapien
ctttttgccatggagggcgtggccaggagccgaggttccgggactgggctgtccctgggcactggtccggcgcaggggccagggcaccagcagtgatgtgyggtggctctcgctctcccccgctgtgctgttttcatcatctgcaaaatctgcttcagaacccaggtctcgcctgcgaaaggtgaaaatgctcccgcggct

SEQ ID NO: 423 - DNA, 201 bp, Homo sapien
tggccatagccatggctactcccatgagagcctctaccacagaggacatggacatgaccatgagcatagccatggaggctatggggagtctggggctccasgcatcaagcaggacctggatgctgtcactctctgggcttatgtgagtctccaggggatgggagagagaagggctggttctggattgttgggaaactccac

SEQ ID NO: 424 - DNA, 201 bp, Homo sapien
caagaggaaggagatcagagtttgcaaagcttttatgtggaccttggtgctgagatcttgcgatccttctccatggagctgcatcttcttgagatgtttayacagagaacagattagcatcagaaaagatatcagggacagagtaaagggtatgaagctccatagggtagttacagtcaaatatgaaagatgtactgtatt

SEQ ID NO: 425 - DNA, 201 bp, Homo sapien
catcaactttcttgctgagaaggaccacaccaccctcctcagtgaggtgatgacgccaaggatcaagctgatggtggctccagcaggcatgacattgaaasaggcaaatgagatccttcagcctagcaagggaagctgcctatggtcaatgatcgccatgagctagtggccatcgtctcccacaccaacctgaagaagaat

SEQ ID NO: 426 - DNA, 201 bp, Homo sapien; identical to SEQ ID NO: 425

SEQ ID NO: 427 - DNA, 201 bp, Homo sapien; identical to SEQ ID NO: 184

SEQ ID NO: 428 - DNA, 201 bp, Homo sapien
agccctttgcagcaacaaagctcttctgatagcaagtggaatatgctgcccttgcagagtggagtggtctaatttggagtttatctgtgctccctaattarggacctgaagagttatcccctgaagagatctcctagctttatttttccagtgctacctccttcttgcttaaccatcagcaaggagcaggggaaatgcctg

SEQ ID NO: 429 - DNA, 201 bp, Homo sapien
aatcattatctgaaatgtttcattgtagaagcagcaatgtgggctccaagtagatgcagcagatccacatgtccctctgagggaaagccatggtgccaatrggcaagaacaccatgatgtgcaaggccatccaagggcacctggaaaacaacccagctctggaaaaactgttgcctcatatccagggaaatgtgggctttg

SEQ ID NO: 430 - DNA, 201 bp, Homo sapien
cgctgaattttatatagtctaggaaacattttcacattggttgtttcagtcaaatacaaagaagttacagaacagcatcgagtacctaagagagaccaaargcatttccttctgtaaagccctgcagctgagggcttacatccgcctggtccaatcagttcatttccaaacaaaggtaggaaatggctgcatcctagtatt

SEQ ID NO: 431 - DNA, 201 bp, Homo sapien
tccattccaacattctgcccatcacagacattccctgggagcacccaaggcaggcggttgtccagcctgtgaatggacacatgcagagacggagagcctgkttcctgagaaggccaagccatgatgggcatctgtagtggctgcaagacagcataatgcgggggaaagagtataggattgggaggcatgggaattggttca

SEQ ID NO: 432 - DNA, 201 bp, Homo sapien
tgtagaagtcagaactttcttgagcgaaaaatatatctgcagggttcgggtgagcccaggtgttgcttgttcaatatcccaagcccagaaagatgagttcrtccttaaaggaaatgacattgaacttgtttcaaattcagctgctttgactcagcaaaccacaacagctaaaaaccaggatatcagaacattttggatggt

SEQ ID NO: 433 - DNA, 201 bp, Homo sapien
gagttcatccttaaaggaaatgacattgaacttgtttcaaattcagctgctttgactcagcaaaccacaacagctaaaaaccaggatatcagaacattttrgatggtatctatgtctctgaaaaagggacagttcagcaggctgatgagtaaaatctaagagttgtacagctacagaaacaagatgtcagataattcctaa

SEQ ID NO: 434 - DNA, 201 bp, Homo sapien; identical to SEQ ID NO: 137

SEQ ID NO: 435 - DNA, 201 bp, Homo sapien
gatagggctattacattaaatctatgattacattagctaaaaagaaaaagcacaagagatgaaacaaaacatccaagaaactcatcaagatttatgcttcragcaatgtcctaatatctgagaatatcaagatatgaggacactaacaaaagtattattattctaccggatcatttaaaaaattccttttgttctgaaatc

SEQ ID NO: 436 - DNA, 201 bp, Homo sapien; identical to SEQ ID NO: 362

SEQ ID NO: 437 - DNA, 201 bp, Homo sapien
gcccagctggtggtgagtgagcaggtgtctgggctccaagccttctgggagctggtggggaggaagagcaggcagggcactgggcctgcctctgaaagggyggatagaagatgccgtggatgaaggcgccttcagggtgggggagccagtccagcctgagccagggccctagggaagttgcgggagggggcagggtgtggt

SEQ ID NO: 438 - DNA, 201 bp, Homo sapien
gtggttatttaaataatatcatattaatgttaaagttcagctgtcatttaatggtatggcttaatcagatgtagcatttaggaaaaatagtttatgcgggmtctacgtggctttcaggttggcagattcaaataaggatttatgggtttcgaaaccaatgtatttctgtccatgtttctgcttgatctacctcacccttta

SEQ ID NO: 439 - DNA, 201 bp, Homo sapien; identical to SEQ ID NO: 431

SEQ ID NO: 440 - DNA, 201 bp, Homo sapien; identical to SEQ ID NO: 432

SEQ ID NO: 441 - DNA, 201 bp, Homo sapien; identical to SEQ ID NO: 433

SEQ ID NO: 442 - DNA, 201 bp, Homo sapien
gccagtctaaaactgtcctccataaaatagggaaatacactttgggaatttcataagctaaacactatttccacattggtcaccatggtgaacacaaatawgcaaaatcgactgaatggtaacaaggcagggagagaacgtgcttcctataggatttgatctgctgcttattctgatcaaagtggaaactgtaaaggttgg

SEQ ID NO: 443 - DNA, 201 bp, Homo sapien
aaaaaagagttcccaaagtgagaccattactcaaaaatttgagatgggaggctaaattgcccctgctgtgtatttagagggttagtattgaataggtcaamaagcatttcctaagtctctaggctgaatttctaatacggtttcttagtaaccattctcttaaagaatgtgagatttgaggtaagctttgctttaagggag

SEQ ID NO: 444 - DNA, 201 bp, Homo sapien
accagcctggccaacaataatgagaccccatctctacagaatattaaaaaaaattttggtctgagagctaggagcaagagcttagggaaaggaggaataaraggaggtagttggctaccaacagacatctgaattcttaaccaatgaagagaaaaaatgtaaaagtggtcccagccgcttgggagaatgaggcaggaggat

SEQ ID NO: 445 - DNA, 201 bp, Homo sapien
cgatgtgctggaaacgcattctcgcctgacatctggccatgactcagattgccatcctggaggcttctttgctaaactttctgcccaactccctgttccayagatgctgtgctccttgtctctccaggcagatcagccctatttgacagattctgtaattacccataagaggcccaagggagatgtttctgtgtatacagt

SEQ ID NO: 446 - DNA, 201 bp, Homo sapien
tattaccagaaagggcataaccttagacaaccgtttccagagtagatgttgctagtgatagaaagaaatcattataattggtttgcctttcctgacctatkaatgttgccctctcccccaactcagccttgaccttccaagacccctctcttcctttccctcagcctctgtctcctacagagatagcactgtttcccttca

SEQ ID NO: 447 - DNA, 201 bp, Homo sapien
ctggtgacaccattccttaacctggcggaggggagcttttcaaggcttatgaaccaggatcatattattccatgtctctgaagcttgggtcggtccctctstccttttctcgtgctagtttctctgtgattacgcattaaaatgtagagccagtcatctctggctcctagagactcccaggttgatgaatgcacacccgtc

SEQ ID NO: 448 - DNA, 201 bp, Homo sapien
ttgaactcctgggctcaagcagtcctcccgccttggcctcccaaagtgctgggattataggtatgagccagcatgcccatgaatcctattttattctgtaytggggtggacgcaactatcaagtcttggtcaattctggggcacacattttgaaattagaagccacatacagaagaacaattgaagaaagatctgctttgg

SEQ ID NO: 449 - DNA, 201 bp, Homo sapien
aataataattaaaaaaatatatagccgagcgtggtggcacatgcctgtaatcccagttacttgggaggctgaggcaggagaattgcttgaacctgggaggygaattatatatataagtattatatattacgtattatataatatatatacgtatatattatatataatgtgtatgtatatattacatatataatatacata

SEQ ID NO: 450 - DNA, 201 bp, Homo sapien
cacattcccattcctttaggcctccatagctttgcttttgctttctgtttcctgaactaaaaaaaaaaaaaaaagtgtagattgccagccttccctttttyctgcacgctaatggcatgtagtgcctccacccttccctatagtgagattaatgacctgctctgtaactcacattgtgtccttctctctccctttccttaa

SEQ ID NO: 451 - DNA, 201 bp, Homo sapien; identical to SEQ ID NO: 363

SEQ ID NO: 452 - DNA, 201 bp, Homo sapien; identical to SEQ ID NO: 424

SEQ ID NO: 453 - DNA, 201 bp, Homo sapien; identical to SEQ ID NO: 184

SEQ ID NO: 454 - DNA, 201 bp, Homo sapien; identical to SEQ ID NO: 318

SEQ ID NO: 455 - DNA, 201 bp, Homo sapien; identical to SEQ ID NO: 324

SEQ ID NO: 456 - DNA, 201 bp, Homo sapien
gtcaattgattctctttttcttctgtttaacgtgtaaatgccatttttcaatctagtagggacattgcattgacatctaaagcatcagttttcccttattwgttaatgaagcccaaatctttatatctagcacaaatctctctcctaaaagcttgaccttatatacctacctgcatactgagtatctccatttttattttt

SEQ ID NO: 457 - DNA, 201 bp, Homo sapien; identical to SEQ ID NO: 372

SEQ ID NO: 458 - DNA, 201 bp, Homo sapien; identical to SEQ ID NO: 373

SEQ ID NO: 459 - DNA, 201 bp, Homo sapien; identical to SEQ ID NO: 374

SEQ ID NO: 460 - DNA, 201 bp, Homo sapien; identical to SEQ ID NO: 389

SEQ ID NO: 461 - DNA, 201 bp, Homo sapien
aactgcggttttctggtgcagggatgcctcctttggctagaagttgatgacattcgcccagcccatggctggtggttcactgcagtctccttctgctgggktcatccaccctgcactccctaattccagtggtcctcttggatagagttttcaaactgcctcatgctggtctcttcctcaggattcacatgtggaccttga

SEQ ID NO: 462 - DNA, 201 bp, Homo sapien
cctcgggcatcagaccctgtgtccactgagaactgtggatgtggaatatgcccaggactgcattctcagccgtgcctgccagccgcacactggtgcccgcytgctgcaccatctatgagataatgtctctccattttgggattgtgacatagttacatcagacctcaatggccagtgcttgcattccaggcctgagatcag

SEQ ID NO: 463 - DNA, 201 bp, Homo sapien
agtgtaacctgaagtgatgtaagccaggcacagaaagacaaataccacatggtctcacttacatgtgaactctaaagagctgaattcatagaaacactgartaaaatagtggctaacaggctgaagggttggaggattggggagatgttggtcaaaggacacaaaatttcagttaggaggaagaagttcaaagatctattg

SEQ ID NO: 464 - DNA, 201 bp, Homo sapien
agggtttggcctaacacacaaaggatgggaagaataaagaaacgatgttccaacagtatttctgcagatctaagctactgaagggatgctggaccaaccaygatagatgcttccttttccgcagtgcctcgaaaaacacttaggagtgtgaaggagtgaaattttatgctattggccttgttctcatttacttttgattat

SEQ ID NO: 465 - DNA, 201 bp, Homo sapien; identical to SEQ ID NO: 409

SEQ ID NO: 466 - DNA, 201 bp, Homo sapien; identical to SEQ ID NO: 411

SEQ ID NO: 467 - DNA, 201 bp, Homo sapien; identical to SEQ ID NO: 423

SEQ ID NO: 468 - DNA, 201 bp, Homo sapien
cagccccccaggtgtgttccagcaagctctattccactagggaagaaatgagtcatcgtatgtgttgatacaggctgaaggccgccacaaacacatacctkcaggagcttctaatctcatcaggaacatgttgagagtctgacggcctgttataacggcgaaccaccctgttccaagcagcgggacttgctctgctttctc

SEQ ID NO: 469 - DNA, 201 bp, Homo sapien; identical to SEQ ID NO: 365

SEQ ID NO: 470 - DNA, 201 bp, Homo sapien; identical to SEQ ID NO: 423

SEQ ID NO: 471 - DNA, 201 bp, Homo sapien
gaggtcagttgatcaccctctgaggagctccccatgcttgaatgactccagagtgcgaatggtatctgggctcaggagtcaaggcttggaactttccatgytgcaaaatcaaaatcactggacagatgacagattcaggagggtcacaagtagcagggactgttaaaggtcttttatgcttctttttttttttttcagagt

SEQ ID NO: 472 - DNA, 201 bp, Homo sapien; identical to SEQ ID NO: 449

SEQ ID NO: 473 - DNA, 201 bp, Homo sapien
tcattcaaaccaggacacatgtaagttccactcatatgtgggagagggaaggcgagcctgtttttgctgagtctctgatctaggcggtctccagagggctmtgtgggttgtacttcttcgatgcccatgtgagagtcaccacagcctgagacacataaggagaatgcagtagtgccagcctgtggccttctgttctgggtt

SEQ ID NO: 474 - DNA, 201 bp, Homo sapien
gatttataatgcaattctaatacaatttcaacagcattttgagtagaaaatgacccattgattttgtaatttatatggaaactaaaagggtcaagaatagycaaaatactaaaggagaagaacaaggtggaaggacttgctctactagatatcaagttttacgctaaagttgtaatgaataaaactatgtggtattggggt

SEQ ID NO: 475 - DNA, 201 bp, Homo sapien; identical to SEQ ID NO: 391

SEQ ID NO: 476 - DNA, 201 bp, Homo sapien
gctcacttgtgtcattgaacctgggacaccccttcaacctagcatttactgcactgttttgaaattatatcagtctgactattctatgaacagctgagtgygggtgcaatatcctcatcactgagatctgccaaatgtctagcacctaccaaaatgtctagtgcaccataggtgcttaagaaacatttgctaaaaatattt

SEQ ID NO: 477 - DNA, 201 bp, Homo sapien
gcgaactcctgaagcttcagctttgtgctgcctgatgttatgagtactgttgtggattgaattgtgcctcccctcaaaaaatacgttgaagtcataatttmcattgtctaacaatgtgagcttatttgaaaataaggtcattgctgatgcagttagttaagatgaaatcatacaggagtaagctgggcccctaatccaatc

SEQ ID NO: 478 - DNA, 201 bp, Homo sapien
gccctgtacaaaccaaccactccaaagctcacactgccagccacccccttcatctaactcacacagcaaggcaatatttccctgccctaaatcgctccagygccaggtactggatgacaaaggacgcctcccctgtcactgtttgatagctcagagctcactgaaattatttaaactagccagttttaaacctgctcagct

SEQ ID NO: 479 - DNA, 201 bp, Homo sapien
ttcctcaaacattcgttatgtggaataaattgcataacgtttgcaatcctgaaatgtcatggtttcttaataaatgggaattactattacgattagtcacmatttaaccctttttacctttttctgtgcaaagaaaacgtaactgtgcattcattgtcttaaccaagcatcatcaagcctgacctggcgatttagcctgat

SEQ ID NO: 480 - DNA, 201 bp, Homo sapien
gcgaatagaatatttttattgtctaatgatcctttctaacctcaatattttttatcttaaactgtatttctatataaatatagctacctaatctttatttwggtttgcgtttacctctttttccattctttgacattctttgacattcaattttgccgtattttacatttaccacttccagtggcacagggctgtaacttt

SEQ ID NO: 481 - DNA, 201 bp, Homo sapien
tatttctagttcttggctattgtggataagttaattatgagtatcatctacaattctttgggtaataagtgttttcatttctcttgagtaaattcctgggygttgaattgaggagaaatagggtggatatctttgtttgtaagaaaacttaatgctgtacatttttttcttacaatgaccatgccagtctttattatagtc

SEQ ID NO: 482 - DNA, 201 bp, Homo sapien
aagttacttccttccagggatgttacgggttttaataggtaccttgcagaccataacgagtctgctgtttactcatcaaacaggaagtgcaatgatgaaasttttttttaaggaatcctaattgtcttagacttccttagttcagataatgaaacagactaaagtgagtgctcagtaaagtcattttaatccctttcatct

SEQ ID NO: 483 - DNA, 201 bp, Homo sapien
tatatgttgagaatgctgttctagcatctgttcaaatgcttcttacatgtgatccaagaaacaagaatgtctttctcctgaaacaacgttgcataatctgrtatttctatgtaccttttaaagtaccgcttgagcaatctgatgagctttcattgatttatacacctgtgaagccacaacaatcaagctgcagagagtttc

SEQ ID NO: 484 - DNA, 201 bp, Homo sapien
ctgcagagagtttctattcatacaaaagtttcttgtgtcactttgactcttgcctccacacctggccttcagacaggccttcagatttgtattctgtcacwatagattaatttacattttataaaatgtcatataaatggaattatgcagtatggattttgtgtctggctttttcattttgcgtactgactttcagattca

SEQ ID NO: 485 - DNA, 201 bp, Homo sapien
tcatgttgctctagtaggggctcttttcaaactcatcttgtatcctttgtatgcctcaaactagatcctcttcagacgttttataaaaagttagtatgaayttattacagtgcaaaaaaaatggaaatccatgcataatgttttcataatatgcatttttcatgaacactttgaagaccccttgcataacgttttagtgtc

SEQ ID NO: 486 - DNA, 201 bp, Homo sapien
ttgtggaaaatggaaggagaacaagagggggcctaacaatatattctatcaactgttcaacttttgtctaaatgaactgtataacaaactggtatataagyccctgaatggataataaaattaactcagtgtccaggaaaactgtacccgcaattcccacgtttgaagtggctttaagttaaatcaaagtggtaaattgtt

SEQ ID NO: 487 - DNA, 201 bp, Homo sapien
gttctcattttgatataaattttagaatttgctcataaatatttaccccagtaaaacttctggtgaaatttttattagaattgcatcgaatataaattcarcttgtaaaattgacatgttaactctattgagtcctccatccataaacaatttttctgttgttcctcatttatgtagttgttctttaatttctttaagcaa

SEQ ID NO: 488 - DNA, 201 bp, Homo sapien
agtctgcttggatttgggtcaagaaacttaggaactacaatttctctgtttgtttggttgtttgtttcctttaaaagcacgtgtgaaacagcaaggaatayattttgctttcgccccattgttctttgtaaactggtgtagtttttatttttttattttttgtcctttggttttgaatagataactagaaatgtaatgggg

SEQ ID NO: 489 - DNA, 201 bp, Homo sapien
atttgaattaatccaaattaccagtataccaccaatataccaacataccacaatataccaatataccacttataatatactagcataaaaatttatttcayggttcatacttttttgtgtggacaaagtggaaatgctaagatttttctcctaagtgcttctctataaattttataatttctgtgttcacacacagttata

SEQ ID NO: 490 - DNA, 201 bp, Homo sapien
agcataaaaatttatttcatggttcatacttttttgtgtggacaaagtggaaatgctaagatttttctcctaagtgcttctctataaattttataatttcwgtgttcacacacagttatatcatgcattttgagctaatgtttatgtttagtatgaaataaaaaccaagggtcaatttttttgtcatatggagagccagtt

SEQ ID NO: 491 - DNA, 201 bp, Homo sapien
ttaacaaaacattgaataacactgaaattatgttagttagattttaccctattttttcaatagagagtcaggaatagccccaaatccttttacctaaggayacgtaatatcagtttgtcttttcttctgccctcactgaagtgctatgacattacaggctcaagagaaaaatttcttaacaatagttctgcatttgccatg

SEQ ID NO: 492 - DNA, 201 bp, Homo sapien
catgcttcggcgacctcacctcgtagtctggaagggaagatcagctgagctccgggggtagaagcagccaccaagagacccggatgccccacctcccgcastcctacctgcaggaaacaagggaagagcgcttgcgcggagggctggtcttgcgcaagcgcagtcaccacgtcctcctatccccacccgccgcgaatttcc

SEQ ID NO: 493 - DNA, 201 bp, Homo sapien
tgtgacatgttcatgatggccataacgaaacccgaatgagggcaaggaacacctggcctgaaaaccgcttaaaggcgctcttaaaccacaaacaataccawgagcgatctgcgccttaagggcatgttcctgctgcacagaactagccagacccacccctttgtttcagcataccccttcgtttcccataagggatacttt

SEQ ID NO: 494 - DNA, 201 bp, Homo sapien
gactctatggttttcccttgagcaactagaaggatgaaatggtcatttcctgagatagagaacatgggggaaagggcaggtttgggaggagaaatcaagartttggtttgggtatgttaactctgagatgccacttagataagaaagaggtggagtaaacattatcctgggaatcattattttatagatgatagtaaaaat

SEQ ID NO: 495 - DNA, 201 bp, Homo sapien
atagcaacacacttcttcaggagcaagaaatgaccccagtgtcacttaggtcaatagtaagtgaatagctgtgggtttagcttaaaggcaaaagtaggacrtggtggttaagagcggatgctttggagtctagcagacctgtgcctaaatcctagaacctaccatctaatagctatgtgtagttggatcttggaagtgggc

SEQ ID NO: 496 - DNA, 201 bp, Homo sapien
aacacataataaacagtagaatcagggaatcaactttcacctcttcaactccaaatctcatgctttttgataccctgtaggctgataataaatttaaaatsactggcatcacatgccggcatacattagagatttcctaaataggacccatggatccactggaaatacatatgaatgtataatcaattctacttaaccaga

SEQ ID NO: 497 - DNA, 201 bp, Homo sapien
gtattccagaatcagcatgcctaaaatttaactatcttcccatcacaactcgatccacttagagctctcactgttagcagcatgtcgcaggttccacccamctgggggtttttatggtccatagtctcctactaagtttccttgaaagaaaaaataaaacttcaagggcccctattaaagtaagtacttacaattttgttg

SEQ ID NO: 498 - DNA, 201 bp, Homo sapien
ccactgattcctcctcctctgaaccagcttagctccctcaaggtcaaagttagaggaacttacttggcaaagaggtttccctagcaaagcacacaaatgastctaggtacttcaatccagcccctttcactgacattaaaatctattcaatatatttttttcagtgtgtttcaaaaacttcatccagacacactgaataga

SEQ ID NO: 499 - DNA, 201 bp, Homo sapien; identical to SEQ ID NO: 477

SEQ ID NO: 500 - DNA, 201 bp, Homo sapien
agcagaaaaaagtgaagaacatagggatatgaggataggttacaaatgagcataagcccctagactgggagtggtcatttctttccccatgtctaaacccygctaagtaaacagccttcttcccacatgaataccaagataaaaaaggttgacccaaattgcccaagggagttaataatggctacttcggattaaagacaa

SEQ ID NO: 501 - DNA, 201 bp, Homo sapien
aggaattactataaaaagctcaaagcagcaatttgacatttatcttcctatcccatctcttcattcccctagtataaaattaaatttccctgtccatcgtrtatgcctaggggtgtgtttcacttgcatagagaatgtagaagcattttatgcttaaaggtatcaggacaagtagacatgtttcagaatagacatcttgct

SEQ ID NO: 502 - DNA, 201 bp, Homo sapien
gtgtcagctccgtctagtactgattgttttggcagtgtccgatcatattgtatttttcatgtttcttcatttcttagtgttatttaatcatttcaattagytctcccatttgttcacataactcagtgagtatacggtgtatattagaaatgaattcaattttgattcttatatgtcagtcaaaaatagcaactgcaacta

SEQ ID NO: 503 - DNA, 201 bp, Homo sapien; identical to SEQ ID NO: 478

SEQ ID NO: 504 - DNA, 201 bp, Homo sapien; identical to SEQ ID NO: 479

SEQ ID NO: 505 - DNA, 15 bp, Homo sapien
gtcctactgcccccg

SEQ ID NO: 506 - DNA, 16 bp, Homo sapien
tgtcctactgccccca

SEQ ID NO: 507 - DNA, 18 bp, Homo sapien
ccccggctcctcttatac

SEQ ID NO: 508 - DNA, 16 bp, Homo sapien
ggaaggtcatcctggg

SEQ ID NO: 509 - DNA, 16 bp, Homo sapien
ggaaggtcatcctgga

SEQ ID NO: 510 - DNA, 23 bp, Homo sapien
cgaagagtttctgtgtggtacag

SEQ ID NO: 511 - DNA, 23 bp, Homo sapien
cctagagacttaggaaatgcttt

SEQ ID NO: 512 - DNA, 23 bp, Homo sapien
cctagagacttaggaaatgcttg

SEQ ID NO: 513 - DNA, 20 bp, Homo sapien
ggtggcagggtgaaactcta

SEQ ID NO: 514 - DNA, 23 bp, Homo sapien
agcttagggaaaggaggaataaa

SEQ ID NO: 515 - DNA, 22 bp, Homo sapien
gcttagggaaaggaggaataag

SEQ ID NO: 516 - DNA, 17 bp, Homo sapien
gcggctgggaccacttt

SEQ ID NO: 517 - DNA, 17 bp, Homo sapien
cgcggagtgtcaagagg

SEQ ID NO: 518 - DNA, 17 bp, Homo sapien
cgcggagtgtcaagaga

SEQ ID NO: 519 - DNA, 19 bp, Homo sapien
gctggcagagtgctgttga

SEQ ID NO: 520 - DNA, 20 bp, Homo sapien
gttgtttgcttcatctctgc

SEQ ID NO: 521 - DNA, 20 bp, Homo sapien
gttgtttgcttcatctctgg

SEQ ID NO: 522 - DNA, 18 bp, Homo sapien
agtgctgggctcaagaac

SEQ ID NO: 523 - DNA, 24 bp, Homo sapien
atttctgaataactgaagttggtc

SEQ ID NO: 524 - DNA, 24 bp, Homo sapien
atttctgaataactgaagttggtt

SEQ ID NO: 525 - DNA, 23 bp, Homo sapien
aaactggcaataactcagattct

SEQ ID NO: 526 - DNA, 20 bp, Homo sapien
cccttctgcttcacctctat

SEQ ID NO: 527 - DNA, 20 bp, Homo sapien
cccttctgcttcacctctac

SEQ ID NO: 528 - DNA, 28 bp, Homo sapien
ctcctacaactcttgcattagcataaga

SEQ ID NO: 529 - DNA, 22 bp, Homo sapien
atattacagtggaaaagaaggg

SEQ ID NO: 530 - DNA, 22 bp, Homo sapien
atattacagtggaaaagaaggc

SEQ ID NO: 531 - DNA, 22 bp, Homo sapien
attatggctgttctcaaacttg

SEQ ID NO: 532 - DNA, 15 bp, Homo sapien
ccagcagtgatgtgc

SEQ ID NO: 533 - DNA, 16 bp, Homo sapien
accagcagtgatgtgt

SEQ ID NO: 534 - DNA, 20 bp, Homo sapien
gcctcagcaggacttctatg

SEQ ID NO: 535 - DNA, 22 bp, Homo sapien
tgatgctaatctgttctctgtg

SEQ ID NO: 536 - DNA, 24 bp, Homo sapien
tctgatgctaatctgttctctgta

SEQ ID NO: 537 - DNA, 23 bp, Homo sapien
ataacaagaggaaggagatcaga

SEQ ID NO: 538 - DNA, 18 bp, Homo sapien
caggcatgacattgaaac

SEQ ID NO: 539 - DNA, 18 bp, Homo sapien
caggcatgacattgaaag

SEQ ID NO: 540 - DNA, 25 bp, Homo sapien
cagaatgtagtctcgattcttcttc

SEQ ID NO: 541 - DNA, 20 bp, Homo sapien
gagcagtgaatcaggttaac

SEQ ID NO: 542 - DNA, 20 bp, Homo sapien
gagcagtgaatcaggttaat

SEQ ID NO: 543 - DNA, 19 bp, Homo sapien
ggcccttgttggtgtctta

SEQ ID NO: 544 - DNA, 23 bp, Homo sapien
acacacatatggtggttcataat

SEQ ID NO: 545 - DNA, 22 bp, Homo sapien
cacacatatggtggttcataac

SEQ ID NO: 546 - DNA, 19 bp, Homo sapien
catgtcccagctcttcttg

SEQ ID NO: 547 - DNA, 14 bp, Homo sapien
acgctgctgttccg

SEQ ID NO: 548 - DNA, 14 bp, Homo sapien
acgctgctgttcca

SEQ ID NO: 549 - DNA, 24 bp, Homo sapien
cagacagacaacaattcagaagaa

SEQ ID NO: 550 - DNA, 17 bp, Homo sapien
acggcatcttctatccg

SEQ ID NO: 551 - DNA, 18 bp, Homo sapien
cacggcatcttctatcca

SEQ ID NO: 552 - DNA, 17 bp, Homo sapien
ccagctggtggtgagtg

SEQ ID NO: 553 - DNA, 18 bp, Homo sapien
gcttggaactttccatgc

SEQ ID NO: 554 - DNA, 19 bp, Homo sapien
ggcttggaactttccatgt

SEQ ID NO: 555 - DNA, 22 bp, Homo sapien
cctttaacagtccctgctactt

SEQ ID NO: 556 - DNA, 20 bp, Homo sapien
atgagcagactctaagctga

SEQ ID NO: 557 - DNA, 18 bp, Homo sapien
gagcagactctaagctgc

SEQ ID NO: 558 - DNA, 18 bp, Homo sapien
tgagtgcctggggaagtt

SEQ ID NO: 559 - DNA, 22 bp, Homo sapien
atgctcaaatgggaaagatgat

SEQ ID NO: 560 - DNA, 21 bp, Homo sapien
tgctcaaatgggaaagatgac

SEQ ID NO: 561 - DNA, 29 bp, Homo sapien
cattacattgcctatcagtgcagttaagt

SEQ ID NO: 562 - DNA, 20 bp, Homo sapien
cagcctcaggagataacagt

SEQ ID NO: 563 - DNA, 20 bp, Homo sapien
cagcctcaggagataacaga

SEQ ID NO: 564 - DNA, 21 bp, Homo sapien
tcaacccttttccacatagat

SEQ ID NO: 565 - DNA, 19 bp, Homo sapien
atggactcctgaagaagca

SEQ ID NO: 566 - DNA, 18 bp, Homo sapien
tggactcctgaagaagcc

SEQ ID NO: 567 - DNA, 20 bp, Homo sapien
tcagtccgctgccttgttat

SEQ ID NO: 568 - DNA, 18 bp, Homo sapien
attagccccaaagcgtac

SEQ ID NO: 569 - DNA, 18 bp, Homo sapien
attagccccaaagcgtag

SEQ ID NO: 570 - DNA, 24 bp, Homo sapien
gctttagaaggctggatatttatg

SEQ ID NO: 571 - DNA, 23 bp, Homo sapien
aactcatcaagatttatgcttca

SEQ ID NO: 572 - DNA, 22 bp, Homo sapien
actcatcaagatttatgcttcg

SEQ ID NO: 573 - DNA, 23 bp, Homo sapien
ctactcaggccagtcttgttact

SEQ ID NO: 574 - DNA, 24 bp, Homo sapien
gcctacagaaagatttcacaaaac

SEQ ID NO: 575 - DNA, 24 bp, Homo sapien
gcctacagaaagatttcacaaaag

SEQ ID NO: 576 - DNA, 25 bp, Homo sapien
aggactctcagacccttcctaaata

SEQ ID NO: 577 - DNA, 21 bp, Homo sapien
ggctttacagaaggaaatgct

SEQ ID NO: 578 - DNA, 20 bp, Homo sapien
gctttacagaaggaaatgcc

SEQ ID NO: 579 - DNA, 22 bp, Homo sapien
gcatgcgctgaattttatatag

SEQ ID NO: 580 - DNA, 19 bp, Homo sapien
cctcagaatggccaaaaac

SEQ ID NO: 581 - DNA, 19 bp, Homo sapien
cctcagaatggccaaaaat

SEQ ID NO: 582 - DNA, 18 bp, Homo sapien
ccaggcagccagacttct

SEQ ID NO: 583 - DNA, 21 bp, Homo sapien
gagagtcgcagggtattttaa

SEQ ID NO: 584 - DNA, 21 bp, Homo sapien
gagagtcgcagggtattttag

SEQ ID NO: 585 - DNA, 18 bp, Homo sapien
aaaggcccaggctctaga

SEQ ID NO: 586 - DNA, 21 bp, Homo sapien
ctagcaaagcacacaaatgac

SEQ ID NO: 587 - DNA, 21 bp, Homo sapien
ctagcaaagcacacaaatgag

SEQ ID NO: 588 - DNA, 22 bp, Homo sapien
ggatgaagtttttgaaacacac

SEQ ID NO: 589 - DNA, 26 bp, Homo sapien
ctttctgtttatctgtgtttcttatc

SEQ ID NO: 590 - DNA, 26 bp, Homo sapien
ctttctgtttatctgtgtttcttatt

SEQ ID NO: 591 - DNA, 21 bp, Homo sapien
gcacagccataatgaacaata

SEQ ID NO: 592 - DNA, 26 bp, Homo sapien
ggctataatggaatgaatcttaacag

SEQ ID NO: 593 - DNA, 26 bp, Homo sapien
ggctataatggaatgaatcttaacaa

SEQ ID NO: 594 - DNA, 26 bp, Homo sapien
gatggatcaagcactttaccaactca

SEQ ID NO: 595 - DNA, 21 bp, Homo sapien
ggaatgggtcaagaatgttcc

SEQ ID NO: 596 - DNA, 21 bp, Homo sapien
ggaatgggtcaagaatgttcg

SEQ ID NO: 597 - DNA, 20 bp, Homo sapien
ggcccaaggcaaaggatttt

SEQ ID NO: 598 - DNA, 26 bp, Homo sapien
cccagcctattcttaatcctatttta

SEQ ID NO: 599 - DNA, 25 bp, Homo sapien
ccagcctattcttaatcctattttg

SEQ ID NO: 600 - DNA, 23 bp, Homo sapien
tcctagcaattccctgtgtgata

SEQ ID NO: 601 - DNA, 20 bp, Homo sapien
cgttcttccaccagaatttt

SEQ ID NO: 602 - DNA, 20 bp, Homo sapien
cgttcttccaccagaatttc

SEQ ID NO: 603 - DNA, 24 bp, Homo sapien
gggctgcacttgtactcttataat

SEQ ID NO: 604 - DNA, 18 bp, Homo sapien
ggagggttgtccctgaag

SEQ ID NO: 605 - DNA, 18 bp, Homo sapien
ggagggttgtccctgaaa

SEQ ID NO: 606 - DNA, 25 bp, Homo sapien
ggtggaagaacgtgaagatgattgt

SEQ ID NO: 607 - DNA, 17 bp, Homo sapien
ttctggggcatacaacg

SEQ ID NO: 608 - DNA, 18 bp, Homo sapien
cttctggggcatacaaca

SEQ ID NO: 609 - DNA, 19 bp, Homo sapien
agggacaaccctccataaa

SEQ ID NO: 610 - DNA, 18 bp, Homo sapien
agaatggcgtctacccag

SEQ ID NO: 611 - DNA, 18 bp, Homo sapien
agaatggcgtctacccaa

SEQ ID NO: 612 - DNA, 24 bp, Homo sapien
caggtagcttggttacccattctt

SEQ ID NO: 613 - DNA, 20 bp, Homo sapien
tgtgaagatccaaaccactc

SEQ ID NO: 614 - DNA, 20 bp, Homo sapien
tgtgaagatccaaaccactt

SEQ ID NO: 615 - DNA, 20 bp, Homo sapien
tgagccatccatcttctaca

SEQ ID NO: 616 - DNA, 33 bp, Homo sapien
gtatgtagtaaatagttaataaaggagtgatac

SEQ ID NO: 617 - DNA, 34 bp, Homo sapien
ggtatgtagtaaatagttaataaaggagtgatat

SEQ ID NO: 618 - DNA, 30 bp, Homo sapien
aaagatactagccatatcattacatgtgtg

SEQ ID NO: 619 - DNA, 16 bp, Homo sapien
cgagtcggtctgctgc

SEQ ID NO: 620 - DNA, 16 bp, Homo sapien
cgagtcggtctgctga

SEQ ID NO: 621 - DNA, 20 bp, Homo sapien
tgcctacctcattccatctg

SEQ ID NO: 622 - DNA, 21 bp, Homo sapien
caaaacagaagagcaagatga

SEQ ID NO: 623 - DNA, 20 bp, Homo sapien
aaaacagaagagcaagatgc

SEQ ID NO: 624 - DNA, 19 bp, Homo sapien
ttttggttcgatggatgtt

SEQ ID NO: 625 - DNA, 19 bp, Homo sapien
gagcaggtagcctgtattt

SEQ ID NO: 626 - DNA, 19 bp, Homo sapien
gagcaggtagcctgtattc

SEQ ID NO: 627 - DNA, 17 bp, Homo sapien
tgctgccttggttgtga

SEQ ID NO: 628 - DNA, 20 bp, Homo sapien
aggactggatgaaatgagtg

SEQ ID NO: 629 - DNA, 21 bp, Homo sapien
aaggactggatgaaatgagtt

SEQ ID NO: 630 - DNA, 20 bp, Homo sapien
gccagagcagagtgacatct

SEQ ID NO: 631 - DNA, 17 bp, Homo sapien
ccagagaagtccaacgc

SEQ ID NO: 632 - DNA, 17 bp, Homo sapien
ccagagaagtccaacgg

SEQ ID NO: 633 - DNA, 22 bp, Homo sapien
gacctccctgacctacttagac

SEQ ID NO: 634 - DNA, 21 bp, Homo sapien
gggttttggttcttaccacac

SEQ ID NO: 635 - DNA, 21 bp, Homo sapien
gggttttggttcttaccacat

SEQ ID NO: 636 - DNA, 22 bp, Homo sapien
ggctgaggttctcatccagtaa

SEQ ID NO: 637 - DNA, 21 bp, Homo sapien
ctgagacaaaattgaggaagc

SEQ ID NO: 638 - DNA, 22 bp, Homo sapien
gctgagacaaaattgaggaagt

SEQ ID NO: 639 - DNA, 24 bp, Homo sapien
tgaaacatcaaacaagaaatcagt

SEQ ID NO: 640 - DNA, 18 bp, Homo sapien
gcgtgatcgcaagagtct

SEQ ID NO: 641 - DNA, 17 bp, Homo sapien
cgtgatcgcaagagtcc

SEQ ID NO: 642 - DNA, 20 bp, Homo sapien
gggtgtctgctgcatctact

SEQ ID NO: 643 - DNA, 16 bp, Homo sapien
ggtcctgcttgatgcg

SEQ ID NO: 644 - DNA, 17 bp, Homo sapien
aggtcctgcttgatgcc

SEQ ID NO: 645 - DNA, 19 bp, Homo sapien
cgaccatggacattcacat

SEQ ID NO: 646 - DNA, 18 bp, Homo sapien
tccactgtttttgaacgc

SEQ ID NO: 647 - DNA, 18 bp, Homo sapien
tccactgtttttgaacgg

SEQ ID NO: 648 - DNA, 24 bp, Homo sapien
taattgcaagaatattgaaagaca

SEQ ID NO: 649 - DNA, 20 bp, Homo sapien
cttccagatcctctgtcttg

SEQ ID NO: 650 - DNA, 21 bp, Homo sapien
gcttccagatcctctgtctta

SEQ ID NO: 651 - DNA, 24 bp, Homo sapien
ccagtgaaggtggaggaaatgatc

SEQ ID NO: 652 - DNA, 20 bp, Homo sapien
agaagctgaaaggaccactt

SEQ ID NO: 653 - DNA, 19 bp, Homo sapien
gaagctgaaaggaccactc

SEQ ID NO: 654 - DNA, 29 bp, Homo sapien
cttctggaatttggtttcctgtttcttag

SEQ ID NO: 655 - DNA, 18 bp, Homo sapien
aatgcagctgctcaaaga

SEQ ID NO: 656 - DNA, 17 bp, Homo sapien
atgcagctgctcaaagg

SEQ ID NO: 657 - DNA, 15 bp, Homo sapien
gttcccgggctcaca

SEQ ID NO: 658 - DNA, 16 bp, Homo sapien
ccaggagccctccaag

SEQ ID NO: 659 - DNA, 16 bp, Homo sapien
ccaggagccctccaac

SEQ ID NO: 660 - DNA, 20 bp, Homo sapien
ggcctcttccactcactaaa

SEQ ID NO: 661 - DNA, 17 bp, Homo sapien
ggcctggtggaagtgat

SEQ ID NO: 662 - DNA, 17 bp, Homo sapien
ggcctggtggaagtgac

SEQ ID NO: 663 - DNA, 17 bp, Homo sapien
ggctgaccgtcatccac

SEQ ID NO: 664 - DNA, 20 bp, Homo sapien
ttacagggtctttctccacc

SEQ ID NO: 665 - DNA, 22 bp, Homo sapien
tcttacagggtctttctccact

SEQ ID NO: 666 - DNA, 22 bp, Homo sapien
agagaaaccccatgaaagtaag

SEQ ID NO: 667 - DNA, 18 bp, Homo sapien
ggcttgttcctgttggaa

SEQ ID NO: 668 - DNA, 18 bp, Homo sapien
ggcttgttcctgttggag

SEQ ID NO: 669 - DNA, 22 bp, Homo sapien
tcaaggtgggagaaagagatgt

SEQ ID NO: 670 - DNA, 19 bp, Homo sapien
catcatggtgttcttgcct

SEQ ID NO: 671 - DNA, 18 bp, Homo sapien
atcatggtgttcttgccc

SEQ ID NO: 672 - DNA, 26 bp, Homo sapien
cattatctgaaatgtttcattgtaga

SEQ ID NO: 673 - DNA, 16 bp, Homo sapien
tggcaaaccatgggta

SEQ ID NO: 674 - DNA, 15 bp, Homo sapien
ggcaaaccatgggtg

SEQ ID NO: 675 - DNA, 22 bp, Homo sapien
tggaacccactttctttcttac

SEQ ID NO: 676 - DNA, 27 bp, Homo sapien
gaaatgcttgtttctttctaaattgta

SEQ ID NO: 677 - DNA, 27 bp, Homo sapien
gaaatgcttgtttctttctaaattgtt

SEQ ID NO: 678 - DNA, 28 bp, Homo sapien
ccaacaatagagaagcagacaaatattc

SEQ ID NO: 679 - DNA, 19 bp, Homo sapien
gagggagacttggttgtcc

SEQ ID NO: 680 - DNA, 18 bp, Homo sapien
agggagacttggttgtcg

SEQ ID NO: 681 - DNA, 24 bp, Homo sapien
cctaattaggaagcaaattcattc

SEQ ID NO: 682 - DNA, 22 bp, Homo sapien
ctcatctctctctaggctagtg

SEQ ID NO: 683 - DNA, 22 bp, Homo sapien
ctcatctctctctaggctagtt

SEQ ID NO: 684 - DNA, 21 bp, Homo sapien
gggaccgctggtctatagtac

SEQ ID NO: 685 - DNA, 20 bp, Homo sapien
cgaagaagtacaacccacat

SEQ ID NO: 686 - DNA, 20 bp, Homo sapien
cgaagaagtacaacccacag

SEQ ID NO: 687 - DNA, 25 bp, Homo sapien
gacacatgtaagttccactcatatg

SEQ ID NO: 688 - DNA, 23 bp, Homo sapien
cactcactggcattttcttctat

SEQ ID NO: 689 - DNA, 22 bp, Homo sapien
actcactggcattttcttctac

SEQ ID NO: 690 - DNA, 28 bp, Homo sapien
cttgtggaaagaagtagggcaaatatca

SEQ ID NO: 691 - DNA, 24 bp, Homo sapien
caaaccacttagtaccactagatg

SEQ ID NO: 692 - DNA, 25 bp, Homo sapien
tcaaaccacttagtaccactagata

SEQ ID NO: 693 - DNA, 25 bp, Homo sapien
ttctcataaaggctcacccaggaaa

SEQ ID NO: 694 - DNA, 27 bp, Homo sapien
gctaaacttatctttgactgattacag

SEQ ID NO: 695 - DNA, 27 bp, Homo sapien
gctaaacttatctttgactgattacaa

SEQ ID NO: 696 - DNA, 25 bp, Homo sapien
ggagttaggaagtgctttgcagaaa

SEQ ID NO: 697 - DNA, 18 bp, Homo sapien
tccacttggtacttgggg

SEQ ID NO: 698 - DNA, 19 bp, Homo sapien
atccacttggtacttggga

SEQ ID NO: 699 - DNA, 23 bp, Homo sapien
ccgctgtggcaactatgtactac

SEQ ID NO: 700 - DNA, 24 bp, Homo sapien
gaaactaaaagggtcaagaatagc

SEQ ID NO: 701 - DNA, 25 bp, Homo sapien
ggaaactaaaagggtcaagaatagt

SEQ ID NO: 702 - DNA, 23 bp, Homo sapien
ccaaccccaataccacatagttt

SEQ ID NO: 703 - DNA, 17 bp, Homo sapien
agtgcagggtggatgac

SEQ ID NO: 704 - DNA, 17 bp, Homo sapien
agtgcagggtggatgaa

SEQ ID NO: 705 - DNA, 21 bp, Homo sapien
ctcctctggggactctcaact

SEQ ID NO: 706 - DNA, 24 bp, Homo sapien
agtttatctgtgctccctaattaa

SEQ ID NO: 707 - DNA, 24 bp, Homo sapien
agtttatctgtgctccctaattag

SEQ ID NO: 708 - DNA, 17 bp, Homo sapien
cctgctccttgctgatg

SEQ ID NO: 709 - DNA, 20 bp, Homo sapien
aacctgaaagccacgtagat

SEQ ID NO: 710 - DNA, 19 bp, Homo sapien
acctgaaagccacgtagag

SEQ ID NO: 711 - DNA, 22 bp, Homo sapien
ctgtccagaaatcattcatcat

SEQ ID NO: 712 - DNA, 18 bp, Homo sapien
acagcagagcagccttaa

SEQ ID NO: 713 - DNA, 18 bp, Homo sapien
acagcagagcagccttag

SEQ ID NO: 714 - DNA, 21 bp, Homo sapien
agtgatgctggaagcacttct

SEQ ID NO: 715 - DNA, 21 bp, Homo sapien
tggatcctgactttgtgaaat

SEQ ID NO: 716 - DNA, 21 bp, Homo sapien
tggatcctgactttgtgaaac

SEQ ID NO: 717 - DNA, 24 bp, Homo sapien
ggaatctgaaggagacatttttac

SEQ ID NO: 718 - DNA, 21 bp, Homo sapien
aacaggagtttgaacttggtt

SEQ ID NO: 719 - DNA, 21 bp, Homo sapien
aacaggagtttgaacttggtc

SEQ ID NO: 720 - DNA, 23 bp, Homo sapien
cagggaaggacggcctaatatca

SEQ ID NO: 721 - DNA, 15 bp, Homo sapien
acgtgctggtgggag

SEQ ID NO: 722 - DNA, 15 bp, Homo sapien
acgtgctggtgggaa

SEQ ID NO: 723 - DNA, 19 bp, Homo sapien
cctcctggagcagctattc

SEQ ID NO: 724 - DNA, 19 bp, Homo sapien
gcccagaaagatgagttca

SEQ ID NO: 725 - DNA, 19 bp, Homo sapien
gcccagaaagatgagttcg

SEQ ID NO: 726 - DNA, 24 bp, Homo sapien
tgtccctttttcagagacatagat

SEQ ID NO: 727 - DNA, 24 bp, Homo sapien
aaaccaggatatcagaacatttta

SEQ ID NO: 728 - DNA, 22 bp, Homo sapien
accaggatatcagaacattttg

SEQ ID NO: 729 - DNA, 25 bp, Homo sapien
ggtcttaggaattatctgacatctt

SEQ ID NO: 730 - DNA, 18 bp, Homo sapien
cttggccttctcaggaac

SEQ ID NO: 731 - DNA, 18 bp, Homo sapien
cttggccttctcaggaaa

SEQ ID NO: 732 - DNA, 25 bp, Homo sapien
aacattctgcccatcacagacattc

SEQ ID NO: 733 - DNA, 21 bp, Homo sapien
caccatggtgaacacaaataa

SEQ ID NO: 734 - DNA, 21 bp, Homo sapien
caccatggtgaacacaaatat

SEQ ID NO: 735 - DNA, 19 bp, Homo sapien
ccgctccaaccaaccttta

SEQ ID NO: 736 - DNA, 23 bp, Homo sapien
gcatgaaacatgggattgtatac

SEQ ID NO: 737 - DNA, 24 bp, Homo sapien
agcatgaaacatgggattgtatat

SEQ ID NO: 738 - DNA, 25 bp, Homo sapien
acactcctggcccttatttatactc

SEQ ID NO: 739 - DNA, 23 bp, Homo sapien
tcaaaattatttcttgctacagg

SEQ ID NO: 740 - DNA, 24 bp, Homo sapien
gtcaaaattatttcttgctacaga

SEQ ID NO: 741 - DNA, 18 bp, Homo sapien
tcctccagcctctcattc

SEQ ID NO: 742 - DNA, 20 bp, Homo sapien
tggatggctgtgattacaac

SEQ ID NO: 743 - DNA, 21 bp, Homo sapien
ttggatggctgtgattacaat

SEQ ID NO: 744 - DNA, 21 bp, Homo sapien
ggcatagttcagccaagttct

SEQ ID NO: 745 - DNA, 27 bp, Homo sapien
tgtcatatatggtttatttactacaac

SEQ ID NO: 746 - DNA, 27 bp, Homo sapien
tgtcatatatggtttatttactacaat

SEQ ID NO: 747 - DNA, 20 bp, Homo sapien
tgacccagcaactgagtgta

SEQ ID NO: 748 - DNA, 17 bp, Homo sapien
ccagccttccctttttc

SEQ ID NO: 749 - DNA, 17 bp, Homo sapien
ccagccttccctttttt

SEQ ID NO: 750 - DNA, 22 bp, Homo sapien
agagagaaggacacaatgtgag

SEQ ID NO: 751 - DNA, 18 bp, Homo sapien
agacacacaggacacatg

SEQ ID NO: 752 - DNA, 18 bp, Homo sapien
agacacacaggacacatc

SEQ ID NO: 753 - DNA, 18 bp, Homo sapien
ttctgctcccagaactag

SEQ ID NO: 754 - DNA, 29 bp, Homo sapien
caagcaagtttctcaaagattatttattc

SEQ ID NO: 755 - DNA, 28 bp, Homo sapien
aagcaagtttctcaaagattatttattg

SEQ ID NO: 756 - DNA, 26 bp, Homo sapien
ggaaattactccaccctctattagtg

SEQ ID NO: 757 - DNA, 21 bp, Homo sapien
catttgctgtgcatgtgttta

SEQ ID NO: 758 - DNA, 19 bp, Homo sapien
tttgctgtgcatgtgtttg

SEQ ID NO: 759 - DNA, 28 bp, Homo sapien
tgggaagatttaacaaggaataagaaga

SEQ ID NO: 760 - DNA, 27 bp, Homo sapien
tattcatgaacaccaggaattaaaatt

SEQ ID NO: 761 - DNA, 25 bp, Homo sapien
ttcatgaacaccaggaattaaaatc

SEQ ID NO: 762 - DNA, 25 bp, Homo sapien
cttaccacccctggaaacacttagt

SEQ ID NO: 763 - DNA, 16 bp, Homo sapien
ctcgggaccagtccag

SEQ ID NO: 764 - DNA, 16 bp, Homo sapien
ctcgggaccagtccaa

SEQ ID NO: 765 - DNA, 16 bp, Homo sapien
ccgacagccgaggaga

SEQ ID NO: 766 - DNA, 19 bp, Homo sapien
cgccacaaacacatacctg

SEQ ID NO: 767 - DNA, 19 bp, Homo sapien
cgccacaaacacatacctt

SEQ ID NO: 768 - DNA, 16 bp, Homo sapien
ccgctgcttggaacag

SEQ ID NO: 769 - DNA, 21 bp, Homo sapien
aagccctgcacattttatctt

SEQ ID NO: 770 - DNA, 20 bp, Homo sapien
agccctgcacattttatctg

SEQ ID NO: 771 - DNA, 23 bp, Homo sapien
gcagtgaaagcctgcattagaga

SEQ ID NO: 772 - DNA, 21 bp, Homo sapien
tcaagagacctatgttggagt

SEQ ID NO: 773 - DNA, 22 bp, Homo sapien
gtcaagagacctatgttggaga

SEQ ID NO: 774 - DNA, 24 bp, Homo sapien
cattgtggaaggctttggctatct

SEQ ID NO: 775 - DNA, 18 bp, Homo sapien
caaggagcacagcatctg

SEQ ID NO: 776 - DNA, 19 bp, Homo sapien
acaaggagcacagcatcta

SEQ ID NO: 777 - DNA, 23 bp, Homo sapien
caagcaggagagagtgtgtaact

SEQ ID NO: 778 - DNA, 17 bp, Homo sapien
gggagagggcaacattc

SEQ ID NO: 779 - DNA, 18 bp, Homo sapien
ggggagagggcaacatta

SEQ ID NO: 780 - DNA, 26 bp, Homo sapien
ccttagacaaccgtttccagagtaga

SEQ ID NO: 781 - DNA, 21 bp, Homo sapien
aaactagcacgagaaaaggag

SEQ ID NO: 782 - DNA, 21 bp, Homo sapien
aaactagcacgagaaaaggac

SEQ ID NO: 783 - DNA, 19 bp, Homo sapien
cagccaaggctggtgacac

What is claimed is:

1. A method of determining whether a human has an increased risk for developing myocardial infarction, comprising testing nucleic acid from said human for the presence or absence of C at a polymorphism in gene VAMP8 at position 101 of SEQ ID NO:377 or G at position 101 of its complement, wherein the presence of said C or said G indicates that said human has an increased risk for developing myocardial infarction, and wherein said human is Caucasian.

2. The method of claim 1, wherein said testing is performed using sequencing, 5' nuclease digestion, molecular beacon assay, oligonucleotide ligation assay, size analysis, single-stranded conformation polymorphism, or denaturing gradient gel electrophoresis (DGGE).

3. The method of claim 1 in which SEQ ID NO:377 is a segment within the genomic sequence of the VAMP8 gene, wherein the nucleotide sequence of the VAMP8 gene comprises SEQ ID NO:254.

4. The method of claim 3 in which the SNP is located at position 14321 of SEQ ID NO:254.

5. The method of claim 1, wherein said nucleic acid is a nucleic acid extract from a biological sample from said human.

6. The method of claim 5 in which said biological sample is blood, saliva, or buccal cells.

7. The method of claim 1, wherein said testing comprises nucleic acid amplification.

8. The method of claim 1, wherein said testing is performed using at least one detection reagent selected from the group consisting of detection reagents comprising the nucleotide sequence of SEQ ID NO:607, detection reagents comprising the nucleotide sequence of SEQ ID NO:608, and detection reagents comprising the nucleotide sequence of SEQ ID NO:609.

9. The method of claim 1, further comprising providing a report of the identity of said SNP.

10. The method of claim 1, further comprising providing a report of said human's increased risk for developing myocardial infarction.

11. The method of claim 10, wherein the report further shows the identity of said SNP.

12. The method of claim 11, wherein the identity of said SNP comprises said C or said G.

13. The method of claim 1, further comprising correlating the presence of said C or said G with an increased risk for developing myocardial infarction.

14. A method of determining whether a human is in need of receiving treatment for myocardial infarction, comprising testing nucleic acid from said human for the presence or absence of C at a polymorphism in gene VAMP8 at position 101 of SEQ ID NO:377 or G at position 101 of its complement, wherein the presence of said C or said G indicates that said human is in need of receiving treatment for myocardial infarction, and wherein said human is Caucasian.

15. The method of claim 14, wherein the method further comprises administering a therapeutic agent to the human.

16. The method of claim 15, wherein the therapeutic agent is a statin.

17. The method of claim 14, wherein said testing is performed using sequencing, 5' nuclease digestion, molecular beacon assay, oligonucleotide ligation assay, size analysis, single-stranded conformation polymorphism, or denaturing gradient gel electrophoresis (DGGE).

18. The method of claim 14 in which SEQ ID NO:377 is a segment within the genomic sequence of the VAMP8 gene, wherein the nucleotide sequence of the VAMP8 gene comprises SEQ ID NO:254.

19. The method of claim 18 in which the SNP is located at position 14321 of SEQ ID NO:254.

20. The method of claim 14, wherein said nucleic acid is a nucleic acid extract from a biological sample from said human.

21. The method of claim 20 in which said biological sample is blood, saliva, or buccal cells.

22. The method of either claim 5 or 20, further comprising preparing said nucleic acid extract from said biological sample prior to said testing.

23. The method of claim 22, further comprising obtaining said biological sample from said human prior to said preparing.

24. The method of claim 14, wherein said testing comprises nucleic acid amplification.

25. The method of claim 14, wherein said testing is performed using at least one detection reagent selected from the group consisting of detection reagents comprising the nucleotide sequence of SEQ ID NO:607, detection reagents comprising the nucleotide sequence of SEQ ID NO:608, and detection reagents comprising the nucleotide sequence of SEQ ID NO:609.

26. The method of either claim 1 or 14, wherein said testing is performed using an allele-specific method.

27. The method of claim 26, wherein said allele-specific method is allele-specific probe hybridization, allele-specific primer extension, or allele-specific amplification.

28. The method of claim 26, wherein said allele-specific method detects said C or said G.

29. The method of claim 14, further comprising correlating the presence of said C or said G with a need of receiving treatment for myocardial infarction.

30. A method of determining whether a human has a decreased risk for developing myocardial infarction, comprising testing nucleic acid from said human for the presence or absence of a homozygous T/T genotype at a polymorphism in gene VAMP8 at position 101 of SEQ ID NO:377 or a homozygous A/A genotype at position 101 of its complement, wherein the presence of said homozygous T/T genotype or said homozygous A/A genotype indicates a decreased risk for developing myocardial infarction in said human as compared to having C at position 101 of SEQ ID NO: 377 or G at position 101 of its complement, and wherein said human is Caucasian.

31. The method of claim 30, further comprising providing a report of the identity of said SNP.

32. The method of claim 30, further comprising providing a report of said human's decreased risk for developing myocardial infarction.

33. The method of claim 32, wherein the report further shows the identity of said SNP.

34. The method of claim 33, wherein the identity of said SNP comprises said homozygous T/T genotype or said homozygous A/A genotype.

35. The method of any one of claims 9-34, wherein the report is in paper form or computer readable medium form.

36. The method of claim 30, wherein said testing comprises nucleic acid amplification.

37. The method of any one of claims 7, 24, and 36, wherein said nucleic acid amplification is carried out by polymerase chain reaction.

38. The method of claim 30, further comprising correlating the presence of said homozygous T/T genotype or said homozygous A/A genotype with a decreased risk for developing myocardial infarction.

39. The method of any one of claims 13, 29, and 38, wherein said correlating is performed by computer software.

40. The method of any one of claims 1, 14, and 30 which is an automated method.

41. A method for determining whether a human has an increased risk for developing myocardial infarction, the method comprising testing nucleic acid from said human to determine the nucleotide content at polymorphism rs1010, wherein the presence of either a C at said polymorphism rs1010 based on the sequence orientation of SEQ ID NO: 377 or a G at said polymorphism rs1010 based on the sequence orientation of the complement of SEQ ID NO:377 indicates said human has an increased risk for developing myocardial infarction, and wherein said human is Caucasian.

* * * * *